US011364292B2

(12) United States Patent
Ciaramella et al.

(10) Patent No.: US 11,364,292 B2
(45) **Date of Patent: *Jun. 21, 2022**

(54) CHIKV RNA VACCINES

(71) Applicant: ModernaTX, Inc., Cambridge, MA (US)

(72) Inventors: Giuseppe Ciaramella, Sudbury, MA (US); Eric Yi-Chun Huang, Boston, MA (US); Kapil Bahl, Medford, MA (US); Tal Zaks, Newton, MA (US); Sunny Himansu, Winchester, MA (US); Sayda Mahgoub Elbashir, Cambridge, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/898,268

(22) Filed: Jun. 10, 2020

(65) Prior Publication Data

US 2020/0368344 A1 Nov. 26, 2020

Related U.S. Application Data

(63) Continuation of application No. 16/009,880, filed on Jun. 15, 2018, now Pat. No. 10,702,597, which is a continuation of application No. 15/746,286, filed as application No. PCT/US2016/043348 on Jul. 21, 2016, now Pat. No. 11,007,260.

(60) Provisional application No. 62/357,806, filed on Jul. 1, 2016, provisional application No. 62/357,267, filed on Jun. 16, 2016, provisional application No. 62/351,200, filed on Jun. 16, 2016, provisional application No. 62/351,206, filed on Jun. 16, 2016, provisional application No. 62/351,244, filed on Jun. 16, 2016, provisional application No. 62/351,148, filed on Jun. 16, 2016, provisional application No. 62/303,666, filed on Mar. 4, 2016, provisional (Continued)

(51) Int. Cl.

| | |
|---|---|
| ***A61K 39/12*** | (2006.01) |
| ***A61K 48/00*** | (2006.01) |
| ***A61K 9/14*** | (2006.01) |
| ***A61K 9/00*** | (2006.01) |
| ***C07K 16/28*** | (2006.01) |
| ***C07K 14/005*** | (2006.01) |
| ***C07K 16/10*** | (2006.01) |
| ***C07K 14/18*** | (2006.01) |
| ***A61K 47/10*** | (2017.01) |
| ***A61K 47/18*** | (2017.01) |
| ***A61K 47/22*** | (2006.01) |
| ***A61K 47/28*** | (2006.01) |
| ***C12N 7/00*** | (2006.01) |
| ***A61P 31/12*** | (2006.01) |
| ***A61P 31/14*** | (2006.01) |
| ***A61K 9/51*** | (2006.01) |
| *A61K 39/00* | (2006.01) |

(52) U.S. Cl.

CPC ........... *A61K 39/12* (2013.01); *A61K 9/0019* (2013.01); *A61K 9/14* (2013.01); *A61K 9/51* (2013.01); *A61K 47/10* (2013.01); *A61K 47/183* (2013.01); *A61K 47/22* (2013.01); *A61K 47/28* (2013.01); *A61K 48/00* (2013.01); *A61P 31/12* (2018.01); *A61P 31/14* (2018.01); *C07K 14/005* (2013.01); *C07K 14/1825* (2013.01); *C07K 16/1081* (2013.01); *C07K 16/2851* (2013.01); *C12N 7/00* (2013.01); *A61K 9/5123* (2013.01); *A61K 2039/505* (2013.01); *A61K 2039/5252* (2013.01); *A61K 2039/5254* (2013.01); *A61K 2039/53* (2013.01); *A61K 2039/543* (2013.01); *A61K 2039/545* (2013.01); *A61K 2039/6056* (2013.01); *C07K 2317/33* (2013.01); *C07K 2317/76* (2013.01); *C12N 2770/24111* (2013.01); *C12N 2770/24122* (2013.01); *C12N 2770/24123* (2013.01); *C12N 2770/24134* (2013.01); *C12N 2770/36034* (2013.01); *C12N 2770/36122* (2013.01); *C12N 2770/36123* (2013.01); *C12N 2770/36134* (2013.01); *Y02A 50/30* (2018.01)

(58) Field of Classification Search

None

See application file for complete search history.

(56) References Cited

U.S. PATENT DOCUMENTS

| | | | |
|---|---|---|---|
| 3,906,092 | A | 9/1975 | Hilleman et al. |
| 6,500,419 | B1 | 12/2002 | Hone et al. |

(Continued)

FOREIGN PATENT DOCUMENTS

| | | | |
|---|---|---|---|
| AU | 652831 | B2 | 9/1994 |
| AU | 2015210364 | A1 | 3/2017 |

(Continued)

OTHER PUBLICATIONS

Noranate et al., Characterization of Chikungunya Virus-Like Particles, 2014, PLoS ONE, vol. 9, No. 9.*

(Continued)

*Primary Examiner* — Benjamin P Blumel

(74) *Attorney, Agent, or Firm* — Wolf, Greenfield & Sacks, P.C.

(57) ABSTRACT

Aspects of the disclosure relate to nucleic acid vaccines. The vaccines include one or more RNA polynucleotides having an open reading frame encoding one or more Chikungunya antigen(s), one or more Zika virus antigens, and one or more Dengue antigens. Methods for preparing and using such vaccines are also described.

20 Claims, 75 Drawing Sheets

Specification includes a Sequence Listing.

Related U.S. Application Data application No. 62/303,405, filed on Mar. 4, 2016, provisional application No. 62/247,581, filed on Oct. 28, 2015, provisional application No. 62/247,644, filed on Oct. 28, 2015, provisional application No. 62/247,527, filed on Oct. 28, 2015, provisional application No. 62/247,660, filed on Oct. 28, 2015, provisional application No. 62/247,551, filed on Oct. 28, 2015, provisional application No. 62/244,859, filed on Oct. 22, 2015, provisional application No. 62/244,855, filed on Oct. 22, 2015, provisional application No. 62/245,233, filed on Oct. 22, 2015, provisional application No. 62/244,995, filed on Oct. 22, 2015, provisional application No. 62/245,179, filed on Oct. 22, 2015, provisional application No. 62/241,699, filed on Oct. 14, 2015, provisional application No. 62/199,204, filed on Jul. 30, 2015, provisional application No. 62/195,263, filed on Jul. 21, 2015.

(56) References Cited

U.S. PATENT DOCUMENTS

| | | | |
|---|---|---|---|
| 6,514,948 | B1 | 2/2003 | Raz et al. |
| 6,610,044 | B2 | 8/2003 | Mathiesen |
| 7,001,890 | B1 | 2/2006 | Wagner et al. |
| 8,217,016 | B2 | 7/2012 | Hoerr et al. |
| 8,440,202 | B2 | 5/2013 | Simmons et al. |
| 8,569,256 | B2 | 10/2013 | Heyes et al. |
| 8,609,142 | B2 | 12/2013 | Troiano et al. |
| 8,613,954 | B2 | 12/2013 | Zale et al. |
| 8,617,608 | B2 | 12/2013 | Zale et al. |
| 8,673,316 | B2 | 3/2014 | Kinney et al. |
| 8,691,961 | B1 | 4/2014 | Puffer et al. |
| 8,710,200 | B2 | 4/2014 | Schrum et al. |
| 8,734,832 | B2 | 5/2014 | O'Hagan et al. |
| 8,734,853 | B2 | 5/2014 | Sood et al. |
| 8,754,062 | B2 | 6/2014 | De Fougerolles et al. |
| 8,822,663 | B2 | 9/2014 | Schrum et al. |
| 8,999,380 | B2 | 4/2015 | Bancel et al. |
| 9,000,141 | B2 | 4/2015 | Chang et al. |
| 9,221,891 | B2 | 12/2015 | Bancel et al. |
| 9,267,114 | B2 | 2/2016 | Yamshchikov et al. |
| 9,283,287 | B2 | 3/2016 | Bancel et al. |
| 9,303,079 | B2 | 4/2016 | Bancel et al. |
| 9,464,124 | B2 | 10/2016 | Bancel et al. |
| 9,512,456 | B2 | 12/2016 | Wang et al. |
| 9,533,047 | B2 | 1/2017 | de Fougerolles et al. |
| 9,597,380 | B2 | 3/2017 | Chakraborty et al. |
| 9,868,691 | B2 | 1/2018 | Benenato et al. |
| 9,872,900 | B2 | 1/2018 | Ciaramella et al. |
| 10,064,934 | B2 | 9/2018 | Ciaramella et al. |
| 10,064,935 | B2 | 9/2018 | Ciaramella et al. |
| 10,124,055 | B2 | 11/2018 | Ciaramella et al. |
| 10,207,010 | B2 | 2/2019 | Besin et al. |
| 10,232,055 | B2 | 3/2019 | Kariko et al. |
| 10,273,269 | B2 | 4/2019 | Ciaramella |
| 10,286,086 | B2 | 5/2019 | Roy et al. |
| 10,385,088 | B2 | 8/2019 | Fraley et al. |
| 10,449,244 | B2 | 10/2019 | Ciaramella et al. |
| 10,465,190 | B1 | 11/2019 | Chen et al. |
| 10,493,143 | B2 | 12/2019 | Ciaramella et al. |
| 10,526,629 | B2 | 1/2020 | Rabideau et al. |
| 10,653,712 | B2 | 5/2020 | Hoge |
| 10,653,767 | B2 | 5/2020 | Ciaramella et al. |
| 10,695,419 | B2 | 6/2020 | Ciaramella et al. |
| 10,857,105 | B2 | 12/2020 | Benenato et al. |
| 10,925,958 | B2 | 2/2021 | Ciaramella |
| 2001/0001066 | A1 | 5/2001 | Cezayirli et al. |
| 2003/0032615 | A1 | 2/2003 | Felgner et al. |
| 2003/0092653 | A1 | 5/2003 | Kisich et al. |
| 2004/0005667 | A1 | 1/2004 | Ratti et al. |
| 2004/0022811 | A1 | 2/2004 | Kelly |
| 2005/0032730 | A1 | 2/2005 | Von Der Mulbe et al. |
| 2005/0059624 | A1 | 3/2005 | Hoerr et al. |
| 2005/0250723 | A1 | 11/2005 | Hoerr et al. |
| 2006/0172003 | A1 | 8/2006 | Meers et al. |
| 2006/0172966 | A1 | 8/2006 | Lipford et al. |
| 2007/0280929 | A1 | 12/2007 | Hoerr et al. |
| 2007/0292453 | A1 | 12/2007 | Floyd et al. |
| 2008/0025944 | A1 | 1/2008 | Hoerr et al. |
| 2008/0171711 | A1 | 7/2008 | Hoerr et al. |
| 2010/0130588 | A1 | 5/2010 | Yaworski et al. |
| 2010/0189729 | A1 | 7/2010 | Hoerr et al. |
| 2010/0203076 | A1 | 8/2010 | Fotin-Mleczek et al. |
| 2010/0239608 | A1 | 9/2010 | Von Der Mulbe et al. |
| 2010/0291156 | A1 | 11/2010 | Barner et al. |
| 2010/0303851 | A1 | 12/2010 | Hoerr et al. |
| 2010/0305196 | A1 | 12/2010 | Probst et al. |
| 2011/0250225 | A1 | 10/2011 | Fotin-Mleczek et al. |
| 2011/0269950 | A1 | 11/2011 | Von Der Mulbe et al. |
| 2011/0311472 | A1 | 12/2011 | Hoerr et al. |
| 2012/0009221 | A1 | 1/2012 | Hoerr et al. |
| 2012/0101148 | A1 | 4/2012 | Aking et al. |
| 2012/0107350 | A1 | 5/2012 | Xu et al. |
| 2012/0189700 | A1 | 7/2012 | Aguilar et al. |
| 2012/0219573 | A1 | 8/2012 | Baumhof et al. |
| 2012/0258046 | A1 | 10/2012 | Mutske |
| 2013/0022538 | A1 | 1/2013 | Rossi |
| 2013/0102034 | A1 | 4/2013 | Schrum et al. |
| 2013/0121988 | A1 | 5/2013 | Hoerr et al. |
| 2013/0142818 | A1 | 6/2013 | Baumhof et al. |
| 2013/0156849 | A1 | 6/2013 | de Fougerolles et al. |
| 2013/0171241 | A1 | 7/2013 | Geall |
| 2013/0183355 | A1 | 7/2013 | Jain et al. |
| 2013/0189351 | A1 | 7/2013 | Geall |
| 2013/0195867 | A1 | 8/2013 | Hoerr et al. |
| 2013/0195967 | A1 | 8/2013 | Guild et al. |
| 2013/0195968 | A1 | 8/2013 | Geall et al. |
| 2013/0195969 | A1 | 8/2013 | Geall et al. |
| 2013/0202684 | A1 | 8/2013 | Geall et al. |
| 2013/0236533 | A1 | 9/2013 | Von Andrian et al. |
| 2013/0236974 | A1 | 9/2013 | De Fougerolles |
| 2013/0243848 | A1 | 9/2013 | Lobovkina et al. |
| 2013/0245103 | A1 | 9/2013 | de Fougerolles et al. |
| 2013/0259923 | A1 | 10/2013 | Bancel et al. |
| 2013/0266640 | A1 | 10/2013 | De Fougerolles et al. |
| 2013/0295043 | A1 | 11/2013 | Kallen et al. |
| 2013/0336998 | A1 | 12/2013 | Kallen et al. |
| 2014/0037660 | A1 | 2/2014 | Folin-Mleczek et al. |
| 2014/0065228 | A1 | 3/2014 | Yarowoski et al. |
| 2014/0134201 | A1 | 5/2014 | Tureci et al. |
| 2014/0147432 | A1 | 5/2014 | Bancel et al. |
| 2014/0148502 | A1 | 5/2014 | Bancel et al. |
| 2014/0193482 | A1 | 7/2014 | Bancel et al. |
| 2014/0206752 | A1 | 7/2014 | Afeyan et al. |
| 2014/0206753 | A1 | 7/2014 | Guild et al. |
| 2014/0271829 | A1 | 9/2014 | Lilja et al. |
| 2014/0308304 | A1 | 10/2014 | Manoharan et al. |
| 2014/0378538 | A1 | 12/2014 | Bancel |
| 2015/0051268 | A1 | 2/2015 | Bancel et al. |
| 2015/0056253 | A1 | 2/2015 | Bancel et al. |
| 2015/0141499 | A1 | 5/2015 | Bancel et al. |
| 2015/0307542 | A1 | 10/2015 | Roy et al. |
| 2015/0315541 | A1 | 11/2015 | Bancel et al. |
| 2016/0024140 | A1 | 1/2016 | Issa et al. |
| 2016/0024141 | A1 | 1/2016 | Issa et al. |
| 2016/0032273 | A1 | 2/2016 | Shahrokh et al. |
| 2016/0038612 | A1 | 2/2016 | Hoge et al. |
| 2016/0243221 | A1 | 8/2016 | Hoge et al. |
| 2016/0271272 | A1 | 9/2016 | Bancel et al. |
| 2016/0317647 | A1 | 11/2016 | Ciaramella et al. |
| 2016/0331828 | A1 | 11/2016 | Ciaramella et al. |
| 2016/0331844 | A1 | 11/2016 | Fotin-Mleczek et al. |
| 2016/0367658 | A1 | 12/2016 | Kinney et al. |
| 2017/0043037 | A1 | 2/2017 | Kariko et al. |
| 2017/0065675 | A1 | 3/2017 | Bancel et al. |
| 2017/0130255 | A1 | 5/2017 | Wang et al. |
| 2017/0202979 | A1 | 7/2017 | Chakraborty et al. |
| 2017/0204152 | A1 | 7/2017 | Nelson et al. |
| 2017/0340724 | A1 | 11/2017 | Ciaramella et al. |
| 2017/0340725 | A1 | 11/2017 | Ciaramella et al. |

(56) References Cited

U.S. PATENT DOCUMENTS

| | | | |
|---|---|---|---|
| 2018/0000953 | A1 | 1/2018 | Almarsson et al. |
| 2018/0002393 | A1 | 1/2018 | Bancel et al. |
| 2018/0028645 | A1 | 2/2018 | Ciaramella et al. |
| 2018/0028664 | A1 | 2/2018 | Besin et al. |
| 2018/0237849 | A1 | 8/2018 | Thompson |
| 2018/0243225 | A1 | 8/2018 | Ciaramella |
| 2018/0243230 | A1 | 8/2018 | Smith |
| 2018/0256628 | A1 | 9/2018 | Hoge et al. |
| 2018/0271795 | A1 | 9/2018 | Martini et al. |
| 2018/0271970 | A1 | 9/2018 | Ciaramella et al. |
| 2018/0273977 | A1 | 9/2018 | Mousavi et al. |
| 2018/0274009 | A1 | 9/2018 | Marquardt et al. |
| 2018/0280496 | A1 | 10/2018 | Ciaramella et al. |
| 2018/0289792 | A1 | 10/2018 | Ciaramella et al. |
| 2018/0303929 | A1 | 10/2018 | Ciaramella et al. |
| 2018/0311336 | A1 | 11/2018 | Ciaramella et al. |
| 2018/0311343 | A1 | 11/2018 | Huang et al. |
| 2018/0312549 | A1 | 11/2018 | Ciaramella |
| 2018/0318409 | A1 | 11/2018 | Valiante et al. |
| 2018/0363019 | A1 | 12/2018 | Hoge |
| 2018/0369374 | A1 | 12/2018 | Frederick et al. |
| 2018/0371047 | A1 | 12/2018 | Ticho et al. |
| 2019/0002890 | A1 | 1/2019 | Martini et al. |
| 2019/0008938 | A1 | 1/2019 | Ciaramella et al. |
| 2019/0085368 | A1 | 3/2019 | Bancel et al. |
| 2019/0099481 | A1 | 4/2019 | Ciaramella et al. |
| 2019/0175517 | A1 | 6/2019 | Martini et al. |
| 2019/0175727 | A1 | 6/2019 | Huang et al. |
| 2019/0192646 | A1 | 6/2019 | Cohen et al. |
| 2019/0192653 | A1 | 6/2019 | Hoge et al. |
| 2019/0275170 | A1 | 9/2019 | Benenato et al. |
| 2019/0298657 | A1 | 10/2019 | Martini et al. |
| 2019/0298658 | A1 | 10/2019 | Benenato |
| 2019/0300906 | A1 | 10/2019 | Martini et al. |
| 2019/0314292 | A1 | 10/2019 | Benenato et al. |
| 2019/0314493 | A1 | 10/2019 | Ciaramella et al. |
| 2019/0336595 | A1 | 11/2019 | Ciaramella |
| 2019/0351040 | A1 | 11/2019 | Valiante et al. |
| 2019/0382774 | A1 | 12/2019 | Hoge et al. |
| 2019/0390181 | A1 | 12/2019 | Benenato et al. |
| 2020/0030432 | A1 | 1/2020 | Ciaramella et al. |
| 2020/0032274 | A1 | 1/2020 | Mauger et al. |
| 2020/0038499 | A1 | 2/2020 | Narayanan et al. |
| 2020/0054737 | A1 | 2/2020 | Ciaramella et al. |
| 2020/0069599 | A1 | 3/2020 | Smith et al. |
| 2020/0069793 | A1 | 3/2020 | Ciaramella |
| 2020/0069794 | A1 | 3/2020 | Ciaramella et al. |
| 2020/0071689 | A1 | 3/2020 | Miracco |
| 2020/0085916 | A1 | 3/2020 | Martini et al. |
| 2020/0109420 | A1 | 4/2020 | Brito et al. |
| 2020/0129608 | A1 | 4/2020 | Ciaramella et al. |
| 2020/0129615 | A1 | 4/2020 | Ciaramella et al. |
| 2020/0163878 | A1 | 5/2020 | Baumhof et al. |
| 2020/0239869 | A1 | 7/2020 | Issa et al. |
| 2020/0254086 | A1 | 8/2020 | Hoge et al. |
| 2020/0282047 | A1 | 9/2020 | Ciaramella et al. |
| 2021/0046173 | A1 | 2/2021 | Ciaramella et al. |
| 2021/0163919 | A1 | 6/2021 | Issa et al. |
| 2021/0187097 | A1 | 6/2021 | Ciaramella et al. |

FOREIGN PATENT DOCUMENTS

| | | | |
|---|---|---|---|
| CA | 2473135 | A1 | 6/2003 |
| EP | 1083232 | B1 | 2/2005 |
| EP | 1301614 | B1 | 11/2006 |
| EP | 1383556 | B1 | 10/2007 |
| EP | 1905844 | A2 | 2/2008 |
| EP | 1026253 | B2 | 12/2012 |
| EP | 2188379 | B1 | 1/2013 |
| EP | 2548960 | A1 | 1/2013 |
| WO | WO 1987/005326 | A1 | 9/1987 |
| WO | WO 1990/011092 | A1 | 10/1990 |
| WO | WO 1993/014778 | A1 | 8/1993 |
| WO | WO 1995/024485 | A2 | 9/1995 |
| WO | WO 1995/026204 | A1 | 10/1995 |
| WO | WO 1995/033835 | A1 | 12/1995 |
| WO | WO 1999/033982 | A2 | 7/1999 |
| WO | WO 1999/052503 | A2 | 10/1999 |
| WO | WO 2001/021810 | A1 | 3/2001 |
| WO | WO 2004/058166 | A2 | 7/2004 |
| WO | WO 2004/076645 | A1 | 9/2004 |
| WO | WO 2005/007689 | A1 | 1/2005 |
| WO | WO 2005/009346 | A2 | 2/2005 |
| WO | WO 2006/056027 | A1 | 6/2006 |
| WO | WO 2006/071903 | A2 | 7/2006 |
| WO | WO 2006/095259 | A2 | 9/2006 |
| WO | WO 2007/095976 | A2 | 8/2007 |
| WO | WO 2008/014979 | A3 | 2/2008 |
| WO | WO 2008/052770 | A2 | 5/2008 |
| WO | WO 2008/083949 | A2 | 7/2008 |
| WO | WO 2009/030254 | A1 | 3/2009 |
| WO | WO 2009/030481 | A1 | 3/2009 |
| WO | WO 2009/095226 | A2 | 8/2009 |
| WO | WO 2009/127230 | A1 | 10/2009 |
| WO | WO 2010/037408 | A1 | 4/2010 |
| WO | WO 2010/037539 | A1 | 4/2010 |
| WO | WO 2010/042877 | A1 | 4/2010 |
| WO | WO 2010/054406 | A1 | 5/2010 |
| WO | WO 2010/088927 | A1 | 8/2010 |
| WO | WO 2010/115046 | A2 | 10/2010 |
| WO | WO 2011/005799 | A2 | 1/2011 |
| WO | WO 2011/026641 | A9 | 3/2011 |
| WO | WO 2011/068810 | A1 | 6/2011 |
| WO | WO 2011/069529 | A1 | 6/2011 |
| WO | WO 2011/069586 | A1 | 6/2011 |
| WO | WO 2011/144358 | A1 | 11/2011 |
| WO | WO 2012/006369 | A2 | 1/2012 |
| WO | WO 2012/006380 | A2 | 1/2012 |
| WO | WO 2012/019630 | A1 | 2/2012 |
| WO | WO 2012/019780 | A1 | 2/2012 |
| WO | WO 2012/075040 | A2 | 6/2012 |
| WO | WO 2012/089225 | A1 | 7/2012 |
| WO | WO 2012/113513 | A1 | 8/2012 |
| WO | WO 2012/116714 | A1 | 9/2012 |
| WO | WO 2012/116715 | A1 | 9/2012 |
| WO | WO 2012/116810 | A1 | 9/2012 |
| WO | WO 2012/116811 | A1 | 9/2012 |
| WO | WO 2013/006834 | A1 | 1/2013 |
| WO | WO 2013/006837 | A1 | 1/2013 |
| WO | WO 2013/006838 | A1 | 1/2013 |
| WO | WO 2013/006842 | A2 | 1/2013 |
| WO | WO 2013/030778 | A2 | 3/2013 |
| WO | WO 2013/052167 | A2 | 4/2013 |
| WO | WO 2013/055905 | A1 | 4/2013 |
| WO | WO 2013/056132 | A2 | 4/2013 |
| WO | WO 2013/059496 | A1 | 4/2013 |
| WO | WO 2013/090186 | A1 | 6/2013 |
| WO | WO 2013/090648 | A1 | 6/2013 |
| WO | WO 2013/102203 | A1 | 7/2013 |
| WO | WO 2013/113502 | A1 | 8/2013 |
| WO | WO 2013/120497 | A1 | 8/2013 |
| WO | WO 2013/120628 | A1 | 8/2013 |
| WO | WO 2013/120629 | A1 | 8/2013 |
| WO | WO 2013/174409 | A1 | 11/2013 |
| WO | WO 2013/185069 | A1 | 12/2013 |
| WO | WO 2014/071963 | A1 | 5/2014 |
| WO | WO 2014/072061 | A1 | 5/2014 |
| WO | WO 2014/089239 | A1 | 6/2014 |
| WO | WO 2014/089486 | A1 | 6/2014 |
| WO | WO 2014/127917 | A1 | 8/2014 |
| WO | WO 2014/144196 | A1 | 9/2014 |
| WO | WO 2014/152027 | A1 | 9/2014 |
| WO | WO 2014/152774 | A1 | 9/2014 |
| WO | WO 2014/152940 | A1 | 9/2014 |
| WO | WO 2014/160243 | A1 | 10/2014 |
| WO | WO 2015/005253 | A1 | 1/2015 |
| WO | WO 2015/013551 | A1 | 1/2015 |
| WO | WO 2015/024667 | A1 | 2/2015 |
| WO | WO 2015/024668 | A2 | 2/2015 |
| WO | WO 2015/164674 | A1 | 4/2015 |
| WO | WO 2015/130584 | A1 | 9/2015 |
| WO | WO 2015/134332 | A2 | 9/2015 |
| WO | WO 2015/189425 | A1 | 12/2015 |
| WO | WO 2016/044023 | A1 | 3/2016 |

(56) References Cited

FOREIGN PATENT DOCUMENTS

| | | | |
|---|---|---|---|
| WO | WO 2016/092460 | A2 | 6/2016 |
| WO | WO 2016/116904 | A1 | 7/2016 |
| WO | WO 2016/164762 | A1 | 10/2016 |
| WO | WO 2016/176330 | A1 | 11/2016 |
| WO | WO 2016/184822 | A1 | 11/2016 |
| WO | WO 2016/201377 | A1 | 12/2016 |
| WO | WO 2016/203025 | A1 | 12/2016 |
| WO | WO 2017/015457 | A1 | 1/2017 |
| WO | WO 2017/015463 | A1 | 1/2017 |
| WO | WO 2017/019935 | A1 | 2/2017 |
| WO | WO 2017/020026 | A1 | 2/2017 |
| WO | WO 2017/021546 | A1 | 2/2017 |
| WO | WO 2017/031232 | A1 | 2/2017 |
| WO | WO 2017/031241 | A1 | 2/2017 |
| WO | WO 2017/062513 | A1 | 4/2017 |
| WO | WO 2017/066789 | A1 | 4/2017 |
| WO | WO 2017/070601 | A1 | 4/2017 |
| WO | WO 2017/070616 | A1 | 4/2017 |
| WO | WO 2017/070618 | A1 | 4/2017 |
| WO | WO 2017/070620 | A1 | 4/2017 |
| WO | WO 2017/070622 | A1 | 4/2017 |
| WO | WO 2017/070623 | A1 | 4/2017 |
| WO | WO 2017/070624 | A1 | 4/2017 |
| WO | WO 2017/075531 | A1 | 5/2017 |
| WO | WO 2017/109222 | A1 | 6/2017 |
| WO | WO 2017/127750 | A1 | 7/2017 |
| WO | WO 2017/140905 | A1 | 8/2017 |
| WO | WO 2017/147458 | A1 | 8/2017 |
| WO | WO 2017/162265 | A1 | 9/2017 |
| WO | WO 2017/165317 | A2 | 9/2017 |
| WO | WO 2017/201333 | A1 | 11/2017 |
| WO | WO 2017/201340 | A1 | 11/2017 |
| WO | WO 2017/201342 | A1 | 11/2017 |
| WO | WO 2017/201347 | A1 | 11/2017 |
| WO | WO 2017/201349 | A1 | 11/2017 |
| WO | WO 2017/208191 | A1 | 12/2017 |
| WO | WO 2017/210215 | A1 | 12/2017 |
| WO | WO 2017/210364 | A1 | 12/2017 |
| WO | WO 2018/020271 | A1 | 2/2018 |
| WO | WO 2018/052549 | A1 | 3/2018 |
| WO | WO 2018/053209 | A1 | 3/2018 |
| WO | WO 2018/075980 | A1 | 4/2018 |
| WO | WO 2018/081459 | A1 | 5/2018 |
| WO | WO 2018/081462 | A1 | 5/2018 |
| WO | WO 2018/089851 | A1 | 5/2018 |
| WO | WO 2018/091540 | A1 | 5/2018 |
| WO | WO 2018/107088 | A1 | 6/2018 |
| WO | WO 2018/111967 | A1 | 6/2018 |
| WO | WO 2018/132537 | A1 | 7/2018 |
| WO | WO 2018/144082 | A1 | 8/2018 |
| WO | WO 2018/144778 | A1 | 8/2018 |
| WO | WO 2018/151816 | A1 | 8/2018 |
| WO | WO 2018/157009 | A1 | 8/2018 |
| WO | WO 2018/170245 | A1 | 9/2018 |
| WO | WO 2018/170256 | A1 | 9/2018 |
| WO | WO 2018/170260 | A1 | 9/2018 |
| WO | WO 2018/170270 | A1 | 9/2018 |
| WO | WO 2018/170347 | A1 | 9/2018 |
| WO | WO 2018/175783 | A1 | 9/2018 |
| WO | WO 2018/187590 | A2 | 10/2018 |
| WO | WO 2018/200737 | A1 | 11/2018 |
| WO | WO 2018/232355 | A1 | 12/2018 |
| WO | WO 2018/232357 | A1 | 12/2018 |
| WO | WO 2019/036670 | A1 | 2/2019 |
| WO | WO 2019/036682 | A1 | 2/2019 |
| WO | WO 2019/036683 | A1 | 2/2019 |
| WO | WO 2019/036685 | A1 | 2/2019 |
| WO | WO 2019/103993 | A1 | 5/2019 |
| WO | WO 2019/148101 | A1 | 8/2019 |
| WO | WO 2020/006242 | A1 | 1/2020 |
| WO | WO 2020/056370 | A1 | 3/2020 |
| WO | WO 2020/061284 | A1 | 3/2020 |
| WO | WO 2020/061295 | A1 | 3/2020 |
| WO | WO 2020/061367 | A1 | 3/2020 |
| WO | WO 2020/097291 | A1 | 5/2020 |
| WO | WO 2020/172239 | A1 | 8/2020 |
| WO | WO 2020/185811 | A1 | 9/2020 |
| WO | WO 2020/190750 | A1 | 9/2020 |
| WO | WO 2020/243561 | A1 | 12/2020 |
| WO | WO 2021/030533 | A1 | 2/2021 |
| WO | WO 2021/050864 | A1 | 3/2021 |
| WO | WO 2021/055811 | A1 | 3/2021 |

OTHER PUBLICATIONS

U.S. Appl. No. 16/036,318, filed Jul. 16, 2018, Ciaramella et al.
U.S. Appl. No. 16/144,394, filed Sep. 27, 2018, Ciaramella et al.
U.S. Appl. No. 90/014,395, filed Oct. 24, 2019, Ciaramella et al.
U.S. Appl. No. 15/748,773, filed Jan. 30, 2018, Ciaramella et al.
U.S. Appl. No. 15/753,293, filed Feb. 17, 2018, Smith.
U.S. Appl. No. 15/753,297, filed Feb. 17, 2018, Thompson.
U.S. Appl. No. 15/748,782, filed Jan. 30, 2018, Mousavi et al.
U.S. Appl. No. 15/767,587, filed Apr. 11, 2018, Ciaramella.
U.S. Appl. No. 16/833,409, filed Mar. 27, 2020, Ciaramella.
U.S. Appl. No. 15/767,600, filed Apr. 11, 2018, Ciaramella et al.
U.S. Appl. No. 15/769,710, filed Apr. 19, 2018, Ciaramella et al.
U.S. Appl. No. 15/767,609, filed Apr. 11, 2018, Ciaramella et al.
U.S. Appl. No. 15/767,613, filed Apr. 11, 2018, Ciaramella et al.
U.S. Appl. No. 15/767,618, filed Apr. 11, 2018, Ciaramella et al.
U.S. Appl. No. 16/853,973, filed Apr. 21, 2020, Ciaramella et al.
U.S. Appl. No. 16/850,519, filed Apr. 16, 2020, Ciaramella et al.
U.S. Appl. No. 15/746,286, filed Jan. 19, 2018, Ciaramella et al.
U.S. Appl. No. 16/897,859, filed Jun. 10, 2020, Ciaramella et al.
U.S. Appl. No. 16/599,661, filed Oct. 11, 2019, Besin et al.
U.S. Appl. No. 16/333,330, filed Mar. 14, 2019, Hoge et al.
U.S. Appl. No. 16/864,566, filed May 1, 2020, Ciaramella et al.
U.S. Appl. No. 16/880,829, filed May 21, 2020, Ciaramella et al.
U.S. Appl. No. 16/897,734, filed Jun. 10, 2020, Ciaramella et al.
U.S. Appl. No. 16/468,838, filed Jun. 12, 2019, Miracco.
U.S. Appl. No. 16/001,765, filed Jun. 6, 2018, Marquardt et al.
U.S. Appl. No. 16/348,943, May 10, 2019, Ciaramella.
U.S. Appl. No. 16/467,142, filed Jun. 6, 2019, Ciaramella et al.
U.S. Appl. No. 16/603,111, filed Oct. 4, 2019, Brito et al.
U.S. Appl. No. 16/482,844, filed Aug. 1, 2019, Valiante et al.
U.S. Appl. No. 16/496,135, filed Sep. 20, 2019, Narayanan et al.
U.S. Appl. No. 16/483,012, filed Aug. 1, 2019, Mauger et al.
U.S. Appl. No. 16/657,122, filed Oct. 18, 2019, Rabideau et al.
U.S. Appl. No. 16/362,366, filed Mar. 22, 2019, Ciaramella.
U.S. Appl. No. 16/493,986, filed Sep. 13, 2019, Ciaramella et al.
U.S. Appl. No. 16/494,130, filed Sep. 13, 2019, Ciaramella et al.
U.S. Appl. No. 16/494,103, filed Sep. 13, 2019, Ciaramella et al.
U.S. Appl. No. 16/494,162, filed Sep. 13, 2019, Ciaramella.
U.S. Appl. No. 16/494,988, filed Sep. 17, 2019, Ciaramella et al.
U.S. Appl. No. 16/639,265, filed Feb. 14, 2020, Issa et al.
U.S. Appl. No. 16/639,305, filed Feb. 14, 2020, Issa et al.
U.S. Appl. No. 16/765,285, filed May 19, 2020, Ciaramella et al.
U.S. Appl. No. 16/302,607, filed Nov. 16, 2018, Benenato et al.
U.S. Appl. No. 16/623,069, filed Dec. 16, 2019, Hoge et al.
U.S. Appl. No. 16/639,403, filed Feb. 14, 2020, Hoge et al.
U.S. Appl. No. 16/848,318, filed Apr. 14, 2020, Ciaramella et al.
U.S. Appl. No. 16/965,589, filed Jul. 28, 2020, Ciaramella et al.
U.S. Appl. No. 16/608,451, filed Oct. 25, 2019, Ciaramella et al.
U.S. Appl. No. 16/788,182, filed Feb. 11, 2020, Panther et al.
U.S. Appl. No. 16/794,318, filed Feb. 19, 2020, Mauger et al.
U.S. Appl. No. 17/000,201, filed Aug. 21, 2020, Stewart-Jones et al.
U.S. Appl. No. 17/000,215, filed Aug. 21, 2020, Stewart-Jones et al.
PCT/US2016/043348, Mar. 22, 2018, International Search Report and Written Opinion.
International Search Report and Written Opinion for Application No. PCT/US2016/043348 dated Mar. 22, 2018.
[No Author Listed], "Messenger RNA", Internet: Wikipedia. Jun. 19, 2013, XP002699196, Retrieved from the Internet: URL: http://en.wikipedia.org/wiki/Messenger RNA.
[No Author Listed], GenBank Accession No. Q5XXP3, RecName: Full=Structural polyprotein; AltName: Full=p. 130; Contains: RecName: Full=Capsid protein; AltName: Full=Coat protein; Short=C; Contains: RecName: Full=p. 62; AltName: Full=E3/E2; Contains: RecName: Full=E3 protein; AltName: Full=Spike glycoprotein E3; 2013.

(56) References Cited

OTHER PUBLICATIONS

Anderson et al., Incorporation of pseudouridine into mRNA enhances translation by diminishing PKR activation, Nucleic Acids Res. Sep. 2010;38(17):5884-92. doi: 10.1093/nar/gkq347. Epub May 10, 2010.
Archer, Induction of a T-cell specific antigen on bone marrow lymphocytes with thymus RNA. Immunology. Jan. 1978;34(1):123-9.
Ashley et al., Bone marrow-generated dendritic cells pulsed with tumor extracts or tumor RNA induce antitumor immunity against central nervous system tumors. J Exp Med. Oct. 6, 1997; 186(7):1177-82.
Bahl et al., Preclinical and Clinical Demonstration of Immunogenicity by mRNA Vaccines against H10N8 and H7N9 Influenza Viruses. Mol Ther. Jun. 7, 2017;25(6):1316-1327. doi: 10.1016/j.ymthe.2017.03.035. Epub Apr. 27, 2017.
Bettinger et al., Peptide-mediated RNA delivery: a novel approach for enhanced transfection of primary and post-mitotic cells. Nucleic Acids Res. Sep. 15, 2001;29(18):3882-91.
Bogers et al., Potent immune responses in rhesus macaques induced by nonviral delivery of a self-amplifying RNA vaccine expressing HIV type 1 envelope with a cationic nanoemulsion. J Infect Dis. Mar. 15, 2015;211(6):947-55. doi: 10.1093/infdis/jiu522. Epub Sep. 18, 2014.
Bonehill et al., Single-step antigen loading and activation of dendritic cells by mRNA electroporation for the purpose of therapeutic vaccination in melanoma patients. Clin Cancer Res. May 2009; 15(10): 3366-3375.
Brito et al., A cationic nanoemulsion for the delivery of next-generation RNA vaccines. Mol Ther. Dec. 2014;22(12):2118-29. doi: 10.1038/mt.2014.133. Epub Jul. 16, 2014.
Burt et al., Chikungunya virus: an update on the biology and pathogenesis of this emerging pathogen. Lancet Infect Dis. Apr. 2017;17(4):e107-e117. doi: 10.1016/S1473-3099(16)30385-1. Epub Feb. 1, 2017.
Chahal et al., An RNA nanoparticle vaccine against Zika virus elicits antibody and CD8+ T cell responses in a mouse model. Sci Rep. Mar. 21, 2017;7(1):252. doi: 10.1038/s41598-017-00193-w.
Chattopadhyay et al., A chimeric vesiculo/alphavirus is an effective alphavirus vaccine. J Virol. Jan. 2013;87(1):395-402.
Cheng et al., Multifunctional triblock copolymers for intracellular messenger RNA delivery. Biomaterials. Oct. 2012; 33(28): 6868-6876.
Conry et al., Characterization of a messenger RNA polynucleotide vaccine vector. Cancer Res. Apr. 1, 1995 ;55 (7):1397-1400.
Cox et al., Predicting Zika virus structural biology: Challenges and opportunities for intervention. Antivir Chem Chemother. Aug. 2015;24(3-4):118-26. doi: 10.1177/2040206616653873. Epub Jun. 13, 2016.
Cu et al., Enhanced Delivery and Potency of Self-Amplifying mRNA Vaccines by Electroporation in Situ, Vaccines, 2013, 1, 367-383. Abstract Only.
Dahlman et al., In vivo endothelial siRNA delivery using polymeric nanoparticles with low molecular weight. Nat Nanotechnol. Aug. 2014;9(8):648-655. doi: 10.1038/nnano.2014.84. Epub May 11, 2014.
Deering et al., Nucleic acid vaccines: prospects for non-viral delivery of mRNA vaccines.Expert Opin Drug Deliv. Jun. 2014;11(6):885-99. doi: 10.1517/17425247.2014.901308. Epub Mar. 26, 2014.
Dicaro et al., In Vivo Delivery of Nucleic Acid-Formulated Microparticles as a Potential Tolerogenic Vaccine for Type 1 Diabetes. Rev Diabet Stud. 2012 Winter;9(4):348-56.
Diken et al., Current Developments in Actively Personalized Cancer Vaccination with a Focus on RNA as the Drug Format. Prog Tumor Res. 2015;42:44-54. doi: 10.1159/000437184. Epub Sep. 4, 2015. Review.
Dowd et al., Rapid development of a DNA vaccine for Zika virus.Science. Oct. 14, 2016;354(6309):237-240. Epub Sep. 22, 2016.
Durbin , Vaccine Development for Zika Virus—Timelines and Strategies. Semin Reprod Med. Sep. 2016;34(5):299-304. Epub Sep. 8, 2016.
Fleeton et al., Self-replicative RNA vaccines elicit protection against influenza A virus, respiratory syncytial virus, and a tickborne encephalitis virus. J Infect Dis. May 1, 2001;183(9):1395-8. Epub Mar. 30, 2001.
Garcia-Arriaza et al., A novel poxvirus-based vaccine, MVA-CHIKV, is highly immunogenic and protects mice against chikungunya infection. J Virol. Mar. 2014;88(6):3527-47. doi: 10.1128/JVI.03418-13. Epub Jan. 8, 2014.
Geall et al., Nonviral delivery of self-amplifying RNA vaccines. Proc Natl Acad Sci U S A. Sep. 4, 2012;109(36):14604-9. doi:10.1073/pnas.1209367109. Epub Aug. 20, 2012.
GenBank Accession No. KJ776791, first seen on NCBI on May 12, 2014.
Gilboa et al., Cancer immunotherapy with mRNA-transfected dendritic cells. lmmunol Rev. Jun. 2004;199:251-63.
Gupta et al., ZikaVR: An Integrated Zika Virus Resource for Genomics, Proteomics, Phylogenetic and Therapeutic Analysis. Sci Rep. Sep. 16, 2016;6:32713. doi: 10.1038/srep32713.
Hadinoto et al., Lipid-polymer Hybrid Nanoparticles as a New Generation Therapeutic Delivery Platform: A Review. Eur J Pharm Biopharm. Nov. 2013;85(3 Pt A):427-43. doi: 10.1016/j.ejpb.2013.07.002. Epub Jul. 17, 2013.
Hecker et al., Non-Viral DNA and mRNA Gene Delivery to the CNS Pre-Operatively for Neuroprotection and Following Neurotrauma. Molecular Therapy. 2004; 9, S258-S258.
Heiser et al., Induction of polyclonal prostate cancer-specific CTL using dendritic cells transfected with amplified tumor RNA. J lmmunol. Mar. 1, 2001; 166(5):2953-60.
Heyes et al., Cationic lipid saturation influences intracellular delivery of encapsulated nucleic acids. J Control Release. Oct. 3, 2005;107(2):276-87.
Hoerr et al., In vivo application of RNA leads to induction of specific cytotoxic T lymphocytes and antibodies. EurJ lmmunol. Jan. 2000;30(1):1-7.
Hoerr et al., Stabilized Messenger RNA (RNActiveTM) as a Tool for Innovative Gene Delivery. Tissue Engineering. Apr. 2007; 13(4): 865-925.
Hoerr, More than a messenger: A new class of drugs-mRNA-based therapeutics. Genetic Engineering & Biotechnology News. Jun. 18, 2013. http://www.genengnews.com/gen-articles/more-than-a-messenger-a-new-class-of-drugs-mrna-based-therapeutics/4916/ [last accessed Mar. 25, 2016].
Holtkamp et al., Modification of antigen-encoding RNA increases stability, translational efficacy, and T-cell stimulatory capacity of dendritic cells. Blood. Dec. 15, 2006;108(13):4009-17.
Jirikowski et al., Reversal of diabetes insipidus in Brattleboro Rats: lntrahypothalamic injection of vasopressin mRNA. Science. Feb. 1992; 255(5047): 996-998.
Kallen et al., A development that may evolve into a revolution in medicine: mRNA as the basis for novel, nucleotide-based vaccines and drugs. Ther Adv Vaccines. Jan. 2014;2(1):10-31. doi: 10.1177/2051013613508729.
Kallen et al., A novel, disruptive vaccination technology: self-adjuvanted RNActive(®) vaccines. Hum Vaccin Immunother. Oct. 2013;9(10):2263-76. doi: 10.4161/hv.25181. Epub Jun. 4, 2013. Review.
Kanapathipillai et al., Nanoparticle targeting of anti-cancer drugs that alter intracellular signaling or influence the tumor microenvironment. Adv Drug Deliv Rev. Dec. 15, 2014;79-80:107-18. doi: 10.1016/j.addr.2014.05.005. Epub May 9, 2014.
Kariko et al., Generating the optimal mRNA for therapy: HPLC purification eliminates immune activation and improves translation of nucleoside-modified, protein-encoding mRNA, Nucleic Acids Research, Oxford University Press, GB, vol. 39, No. 21, Sep. 2, 2011 (Sep. 2, 2011), e142. doi: 10.1093/nar/gkr695. Epub Sep. 2, 2011.
Kauffman et al., Efficacy and immunogenicity of unmodified and pseudouridine-modified mRNA delivered systemically with lipid nanoparticles in vivo. Biomaterials. Dec. 2016;109:78-87. doi: 10.1016/j.biomaterials.2016.09.006. Epub Sep. 25, 2016.

(56) References Cited

OTHER PUBLICATIONS

Khan et al., Complete nucleotide sequence of chikungunya virus and evidence for an internal polyadenylation site.J Gen Virol. Dec. 2002;83(Pt 12):3075-84.
Kisich et al., Antimycobacterial agent based on mRNA encoding human beta-defensin 2 enables primary macrophages to restrict growth of *Mycobacterium tuberculosis*.Infect Immun. Apr. 2001;69(4):2692-9.
Kofler et al., Mimicking live flavivirus immunization with a non-infectious RNA vaccine. Proc Natl Acad Sci U S A. Feb. 17, 2004;101(7):1951-6. Epub Feb. 9, 2004.
Kozielski et al., Bioreducible Cationic Polymer-Based Nanoparticles for Efficient and Environmentally Triggered Cytoplasmic siRNA Delivery to Primary Human Brain Cancer Cells. ACS Nano. Apr. 22, 2014;8(4):3232-41. doi: 10.1021/nn500704t. Epub Apr. 3, 2014.
Kreiter et al., lntranodal vaccination with naked antigen-encoding RNA elicits potent prophylactic and therapeutic antitumoral immunity. Cancer Res. 2010; 70: 9031-9040.
Kreiter et al., Tumor vaccination using messenger RNA: prospects of a future therapy. Curr Opinion in lmmun. Jun. 2011; 23(3): 399-406.
Kuhn et al., mRNA as a versatile tool for exogenous protein expression. Current Gene Therapy. Oct. 2012; 12(5): 347-361.
Leitner et al., DNA and RNA-based vaccines: principles, progress and prospects. Vaccine. Dec. 10, 1999;18 (9-10):765-77.
Li et al., Overcoming obstacles to develop effective and safe siRNA therapeutics. Expert Opin Biol Ther. May 2009; 9(5): 609-19.
Lian et al., Trends and developments in liposome drug delivery systems. J Pharm Sci. Jun. 2001;90(6):667-80.
Liang et al., Efficient Targeting and Activation of Antigen-Presenting Cells In Vivo after Modified mRNA Vaccine Administration in Rhesus Macaques. Mol Ther. Dec. 6, 2017;25(12):2635-2647. doi: 10.1016/j.ymthe.2017.08.006. Epub Aug. 12, 2017.
Lindgren et al., Induction of Robust B Cell Responses after Influenza mRNA Vaccination Is Accompanied by Circulating Hemagglutinin-Specific ICOS+ PD-1+ CXCR3+ T Follicular Helper Cells. Front Immunol. Nov. 13, 2017;8:1539. doi: 10.3389/fimmu.2017.01539. eCollection 2017.
Lorenzi et al., Intranasal vaccination with messenger RNA as a new approach in gene therapy: Use against tuberculosis. BMC Biotechnol. Oct. 2010; 10(77): 1-11.
MacLachlan, Lipid Nanoparticle-mediated delivery of messenger RNA. Presentation. 1st International mRNA Health Conference. Tubingen, Germany. Oct. 24, 2013. http://files.shareholder.com/downloads/ABEA-50QJTB/2628241206x0x699789/47543d12-db34-4e6e-88a9-f3ae5d97b1d2/MacLachlan_mRNA_Conf_2013.pdf. Last accessed Dec. 22, 2016.
Madden et al., Administration of nucleoside-modified mRNA encoding broadly neutralizing antibody protects humanized mice from HIV-1 challenge. Nat Commun. Mar. 2, 2017;8:14630. doi: 10.1038/ncomms14630. Available at https://acuitastx.com/wp-content/uploads/2015/01/Poster-Second-International-mRNA-Health-Conference.pdf.
Madden et al., Systemic delivery of mRNA therapeutics using lipid nanoparticles (LNP): improved potency for novel LNP and influence of route of administration on protein expression. 2nd International mRNA Health Conference. Nov. 12, 2014. https://acuitastx.com/wp-content/uploads/2015/01/Poster-Second-International-mRNA-Health-Conference.pdf. 1 page.
Magini et al., Self-Amplifying mRNA Vaccines Expressing Multiple Conserved Influenza Antigens Confer Protection against Homologous and Heterosubtypic Viral Challenge. PLoS One. Aug. 15, 2016;11(8):e0161193. doi: 10.1371/journal.pone.0161193. eCollection 2016.
Martinon et al., Induction of virus-specific cytotoxic T lymphocytes in vivo by liposome-entrapped mRNA. EurJ lmmunol. Jul. 1993;23(7):1719-22.
McKenzie et al., Nucleic acid vaccines: tasks and tactics. lmmunol Res. 2001;24(3):225-44.
McSweegan et al., The Global Virus Network: Challenging chikungunya. Antiviral Res. Aug. 2015;120:147-52. doi: 10.1016/j.antiviral.2015.06.003. Epub Jun. 10, 2015.
Midoux et al., Lipid-based mRNA vaccine delivery systems. Expert Rev Vaccines. Feb. 2015;14(2):221-34. doi: 10.1586/14760584.2015.986104. Epub Dec. 26, 2014. Review.
Mitchell et al., RNA transfected dendritic cells as cancer vaccines. Curr Opin Mol Ther. Apr. 2000;2(2):176-81.
Mitchell et al., RNA-transfected dendritic cells in cancer immunotherapy. J Clin Invest. Nov. 2000;106 (9):1065-9.
Mitchell, Da et al., RNA-transfected dendritic cells in cancer immunotherapy. J Clin Invest. Nov. 2000;106 (9):1065-9.
Mockey et al., mRNA-based cancer vaccine: prevention of B16 melanoma progression and metastasis by systemic injection of MART1 mRNA histidylated lipopolyplexes. Cancer Gene Ther. Sep. 2007;14(9):802-14. Epub Jun. 22, 2007.
Muller et al., Transfection of dendritic cells with RNA induces CD4- and COB-mediated T cell immunity against breast carcinomas and reveals the immunodominance of presented T cell epitopes. J lmmunol. Jun. 15, 2003; 170 (12):5892-6.
Pardi et al., Expression Kinetics of Nucleoside-Modified mRNA Delivered in Lipid Nanoparticles to Mice by Various Routes. J Control Release. Nov. 10, 2015;217:345-51. doi: 10.1016/j.jconrel.2015.08.007. Epub Aug. 8, 2015.
Pardi et al., Zika virus protection by a single low-dose nucleoside-modified mRNA vaccination. Nature. Mar. 9, 2017;543(7644):248-251. doi: 10.1038/nature21428. Epub Feb. 2, 2017.
Parisien et al., Rationalization and prediction of selective decoding of pseudouridine-modified nonsense and sense codons. RNA. Mar. 2012;18(3):355-67. doi: 10.1261/rna.031351.111. Epub Jan. 26, 2012.
Petsch et al., Protective efficacy of in vitro synthesized, specific mRNA vaccines against influenza A virus infection. Nat Biotechnol. Dec. 2012;30(12):1210-6. doi: 10.1038/nbt.2436. Epub Nov. 25, 2012.
Phua et al., Messenger RNA (mRNA) nanoparticle tumour vaccination. Nanoscale. Jul. 21, 2014;6(14):7715-29. doi: 10.1039/c4nr01346h. Review.
Pollard et al., Type I IFN counteracts the induction of antigen-specific immune responses by lipid-based delivery of mRNA vaccines. Mol Ther. Jan. 2013; 21 (1): 251-259.
Pulford et al., Liposome-siRNA-peptide complexes cross the blood-brain barrier and significantly decrease PrP'C on neuronal cells and PrP'RES in infected cell cultures. PLoS ONE. 201 O; 5(6): e11085.
Rabinovich et al., Synthetic messenger RNA as a tool for gene therapy. Hum. Gene Ther. Oct. 2006; 17: 1027-1035.
Richner et al., Modified mRNA Vaccines Protect against Zika Virus Infection. Cell. Mar. 23, 2017;169(1):176. doi: 10.1016/j.cell.2017.03.016.
Richner et al., Vaccine Mediated Protection Against Zika Virus-Induced Congenital Disease. Cell. Jul. 13, 2017;170(2):273-283.e12. doi: 10.1016/j.cell.2017.06.040.
Rittig et al., Intradermal vaccinations with RNA coding for TAA generate CD8+ and CD4+ immune responses and induce clinical benefit in vaccinated patients. Mol Ther. May 2011;19(5):990-9. doi: 10.1038/mt.2010.289. Epub Dec. 28, 2010.
Schirrmacher et al., Intra-pinna anti-tumor vaccination with self-replicating infectious RNA or with DNA encoding a model tumor antigen and a cytokine. Gene Ther. Jul. 2000;7(13):1137-47.
Schmitt et al., In vitro induction of a bladder cancer-specific T-cell response by mRNA-transfected dendritic cells. J Cancer Res Clin Oncol. 2001 ;127(3):203-6.
Schott et al., Viral and non-viral approaches for transient delivery of mRNA and proteins. Current Gene Ther. 2011; 11 (5): 382-398.
Segura et al., Monitoring gene therapy by external imaging of mRNA: Pilot study on murine erythropoietin. Ther Drug Monit. Oct. 2007; 29(5): 612-8.
Shawan et al., In Silico Modeling and Immunoinformatics Probing Disclose the Epitope Based Peptide Vaccine Against Zika Virus Envelope Glycoprotein. Indian. J. Pharm. Biol. Res. Dec. 10, 2014;2(4):44-57.
Smits et al. RNA-based gene transfer for adult stem cells and T cells. Leukemia. 2004; 18: 1898-1902.

(56) References Cited

OTHER PUBLICATIONS

Sohn et al., In-vivo particle mediated delivery of mRNA to mammalian tissues: ballistic and biological effects. Wound Rep and Regen. Jul.-Aug. 2001; 287-296.
Strong et al., Incorporation of beta-globin untranslated regions into a Sindbis virus vector for augmentation of heterologous mRNA expression. Gene Ther. Jun. 1997;4(6):624-7.
Sullenger et al., Emerging clinical applications of RNA. Nature. Jul. 11, 2002;418(6894):252-8.
Tavernier et al., mRNA as gene therapeutic: How to control protein expression. J. of Controlled Release. Mar. 2011; 150(3): 238-247.
Tekmira, Lipid Nanoparticle-mediated delivery of messenger RNA (retrieved from the internet). Published Oct. 24, 2013. Available at http://files.shareholder.com/downloads/ABEA-50QJTB/2628241206x0x699789/47543d12-db34-4e6e-88a9-f3ae5d97b1d2/MacLachlan_mRNA_Conf_2013.pdf.
Teufel et al., Human peripheral blood mononuclear cells transfected with messenger RNA stimulate antigen- specific cytotoxic T-lymphocytes in vitro. Cell Mol Life Sci. Aug. 2005;62(15):1755-62.
Thess et al., Sequence-engineered mRNA Without Chemical Nucleoside Modifications Enables an Effective Protein Therapy in Large Animals. Mol Ther. Sep. 2015;23(9):1456-64. doi: 10.1038/mt.2015.103. Epub Jun. 8, 2015.
Vassilev et al., Microparticle-mediated RNA immunization against bovine viral diarrhea virus. Vaccine. Feb. 28, 2001;19(15-16):2012-9.
Wang et al., Systemic delivery of modified mRNA encoding herpes simplex virus 1 thymidine kinase for targeted cancer gene therapy. Mol Ther. Feb. 2013;21(2):358-67. doi: 10.1038/mt.2012.250. Epub Dec. 11, 2012.
Weber et al., A small antigenic determinant of the Chikungunya virus E2 protein is sufficient to induce neutralizing antibodies which are partially protective in mice. PLoS Negl Trop Dis. Apr. 23, 2015;9(4):e0003684. doi: 10.1371/journal.pntd.0003684. eCollection Apr. 2015.
Weilhammer et al., The use of nanolipoprotein particles to enhance the immunostimulatory properties of innate immune agonists against lethal influenza challenge. Biomaterials. Dec. 2013;34(38):10305-18. doi: 10.1016/j.biomaterials.2013.09.038. Epub Sep. 27, 2013.
Wong et al., An mRNA vaccine for influenza. Nat Biotechnol. Dec. 2012;30(12):1202-4. doi: 10.1038/nbt.2439.
Wong et al., An mRNA-based vaccine strategy against Zika. Cell Res. Sep. 2017;27(9):1077-1078. doi: 10.1038/cr.2017.53. Epub Apr. 11, 2017.
Yamamoto et al., Current prospects for mRNA gene delivery. Eur J Pharm Biopharm. Mar. 2009;71(3):484-9. doi: 10.1016/j.ejpb.2008.09.016. Epub Oct. 10, 2008.
Ying et al., Cancer therapy using a self-replicating RNA vaccine. Nat Med. Jul. 1999;5(7):823-7.
Zhou et al., RNA melanoma vaccine: induction of antitumor immunity by human glycoprotein 100 mRNA immunization. Hum Gene Ther. Nov. 1, 1999;10(16):2719-24.
Kumar et al., Shielding of Lipid Nanoparticles for siRNA Delivery: Impact on Physicochemical Properties, Cytokine Induction, and Efficacy. Mol Ther Nucleic Acids. Nov. 18, 2014;3(11):e210. doi: 10.1038/mtna.2014.61.
Kurimoto et al., PEG-OligoRNA Hybridization of mRNA for Developing Sterically Stable Lipid Nanoparticles toward In Vivo Administration. Molecules. Apr. 3, 2019;24(7): 1303.
U.S. Appl. No. 16/348,943, filed May 10, 2019, Ciaramella.
Cullis et al., Lipid Nanoparticle Systems for Enabling Gene Therapies. Mol Ther. Jul. 5, 2017;25(7):1467-1475. doi: 10.1016/j.ymthe.2017.03.013. Epub Apr. 13, 2017.
Hassett et al., Optimization of Lipid Nanoparticles for Intramuscular Administration of mRNA Vaccines. Mol Ther Nucleic Acids. Apr. 15, 2019;15:1-11. Epub Feb. 7, 2019.
Kowalski et al., Delivering the Messenger: Advances in Technologies for Therapeutic mRNA Delivery. Molecular Therapy vol. 27 No. 4 Apr. 2019.
Pardi et al., mRNA vaccines—a new era in vaccinology. Nat Rev Drug Discov. Apr. 2018;17(4):261-279. doi: 10.1038/nrd.2017.243. Epub Jan. 12, 2018.
Reichmuth et al., mRNA Vaccine Delivery Using Lipid Nanoparticles. Ther Deliv. 2016;7(5):319-34. doi: 10.4155/tde-2016-0006.
Sabnis et al., A Novel Amino Lipid Series for mRNA Delivery: Improved Endosomal Escape and Sustained Pharmacology and Safety in Non-human Primates. Mol Ther. Jun. 6, 2018;26(6):1509-1519. doi: 10.1016/j.ymthe.2018.03.010. Epub Mar. 14, 2018.
Schlake et al., Developing mRNA-vaccine technologies. RNA Biol. Nov. 2012;9(11):1319-30. doi: 10.4161/rna.22269. Epub Oct. 12, 2012.
Zhao et al., Nanoparticle vaccines. Vaccine. Jan. 9, 2014;32(3):327-37. doi: 10.1016/j.vaccine.2013.11.069. Epub Dec. 2, 2013.

* cited by examiner

Three mRNA constructs encoded CHIKV envelope protein design and tested

| Group (n=5) | Vaccine | Vaccine Schedule | Dosage/Route | Challenge | Readout | Day 6 post-infection (survivor/total) |
|---|---|---|---|---|---|---|
| 1 | E1 | Day 0 | IM, LNP 2 μg | Challenge with 1e4 PFU per mouse of CHIK 181/25 via ID injection (Day 56). Weights and health for 10 days | Retro-orbital bleeds on Days 7, 28, 56.<br><br>Serum of mice that survive challenge will undergo E1 & E2 ELISA testing. | 0/5 |
| 2 | | Day 0, 28 | | | | 0/5 |
| 3 | | Day 0 | ID, LNP 2 μg | | | 0/5 |
| 4 | | Day 0, 28 | | | | 0/5 |
| 5 | E2 | Day 0 | IM, LNP 2 μg | | | 0/5 |
| 6 | | Day 0, 28 | | | | 4/5 |
| 7 | | Day 0 | ID, LNP 2 μg | | | 0/5 |
| 8 | | Day 0, 28 | | | | 5/5 |
| 9 | E1/E2/E3 C | Day 0 | IM, LNP 2 μg | | | 5/5 |
| 10 | | Day 0, 28 | | | | 5/5 |
| 11 | | Day 0 | ID, LNP 2 μg | | | 4/5 |
| 12 | | Day 0, 28 | | | | 5/5 |
| 13 | HI CHIKV (+) | Day 0 | IN, 20 ul | | | 0/5 |
| 14 | | Day 0, 28 | | | | 0/5 |
| 15 | (-) | | | | | 0/5 |

Fig. 7

| Group (n=5) | Vaccine | Vaccine Schedule | Dosage/Route | Challenge | Readout | Day 6 post-infection (survivors/total) |
|---|---|---|---|---|---|---|
| 1 | E1 | Day 0 | IM, LNP 10 µg | Challenge with 1e4 PFU per mouse of CHIK 181/25 via ID injection (Day 56). Weights and health for 10 days | Retro-orbital bleeds on Days 7, 28, 56. Serum of mice that survive challenge will undergo E1 & E2 ELISA testing. | 0/5 |
| 2 | | Day 0, 28 | | | | 3/5 |
| 3 | | Day 0 | ID, LNP 10 µg | | | 0/5 |
| 4 | | Day 0, 28 | | | | 4/5 |
| 5 | E2 | Day 0 | IM, LNP 10 µg | | | 0/5 |
| 6 | | Day 0, 28 | | | | 5/5 |
| 7 | | Day 0 | ID, LNP 10 µg | | | 0/5 |
| 8 | | Day 0, 28 | | | | 5/5 |
| 9 | E1/E2/E3 C | Day 0 | IM, LNP 10 µg | | | 5/5 |
| 10 | | Day 0, 28 | | | | 5/5 |
| 11 | | Day 0 | ID, LNP 10 µg | | | 5/5 |
| 12 | | Day 0, 28 | | | | 5/5 |
| 13 | HI CHIKV (+) | Day 0 | IN, 20 ul | | | 0/5 |
| 14 | | Day 0, 28 | | | | 0/5 |
| 15 | (-) | | | | | 0/5 |

Fig. 11 homology
SEQ ID NO: 315
W L/M V H R/K Q W F L/F D L P L P W
SEQ ID NO: 316
N/I Q/R/Y K/Q E/D T/L/R M/L V T F K E/T/V P/A H A K
affinity
| | 1 | 2 | 3 | 4 |
|---|---|---|---|---|
| HLA-DQA1*10:01/DQB1*06:01 | 205 | 166 | 135 | 205 |
| HLA-DRB3*01:01 | 139 | 140 | 183 | 139 |
| HLA-DRB1*03:01 | 142.3 | 129.8 | 506 | 142.3 |
| HLA-DRB4*01:01 | 461 | | | 461 |
| HLA-DPA1*02:01/DPB1*01:01 | | 216 | 214 | |
| HLA-DPA1*01:03/DPB1*02:01 | | | 76 | |
| | 1 | 2 | 3 | 4 |
|---|---|---|---|---|
| HLA-DRB1*04:01 | 7.3 | 12.3 | 5.2 | 63.8 |
| HLA-DRB1*08:02 | 54.8 | 117.4 | 53.6 | 150.7 |
| HLA-DRB1*09:01 | 181 | 356 | 265 | 583 |
| HLA-DRB1*11:01 | 153.7 | 159.3 | 197.8 | 369.1 |
| HLA-DRB1*04:05 | 115.1 | 118 | 39.8 | |
| HLA-DRB1*01:01 | 125.5 | 171.6 | 87.6 | 114.1 |
| HLA-DRB1*15:01 | | 5.7 | 3.2 | 36.1 |
☐ High IC50 nM
☐ Intermediate IC50 nM
☐ Low IC50 nM
frequency
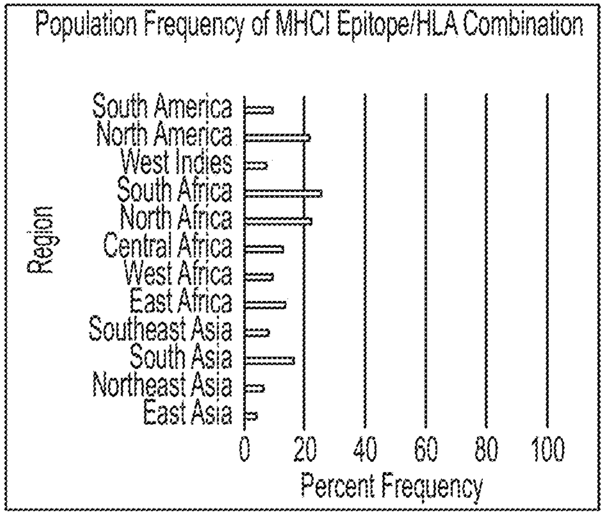
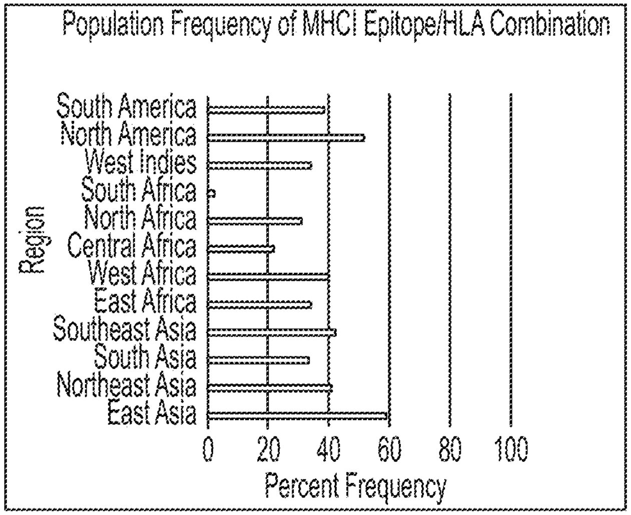
design
| | | | | | | | | | | | | | | | |
|---|---|---|---|---|---|---|---|---|---|---|---|---|---|---|---|
| 1 | | | | | K | | | | | | | | | | |
| 2 | | | | | R | | | | | | | | | | |
| 3 | | M | | | R | | | | F | | | | | | |
| 4 | | | | | K | | | | | | | | | | |
| | | | | | | | | | | | | | | | |
|---|---|---|---|---|---|---|---|---|---|---|---|---|---|---|---|
| 1 | | | Q | D | | | | | | | T | A | | | |
| 2 | I | Q | | | T | | | | | | | P | | | |
| 3 | | | | | | | | | | | | A | | | |
| 4 | | Y | | | R | M | | | | | V | P | | | |
Fig. 17B SEQ ID NO: 317
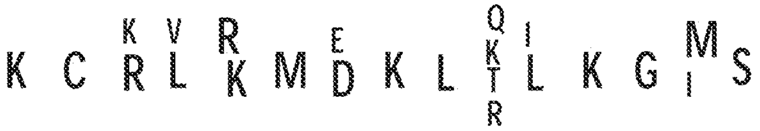
| | | | | |
|---|---|---|---|---|
| HLA-DRB1*03:01 | 83.3 | 37 | 75 | 1891 |
| HLA-DRB4*01:01 | 386 | 109 | 465 | |
| HLA-DRB5*01:01 | 158.2 | 439 | 21.4 | 44.3 |
| HLA-DRB1*04:01 | 106 | | | |
| HLA-DRB3*01:01 | | 468 | 840 | |
| HLA-DRB1*11:01 | | 176.1 | | 117.6 |
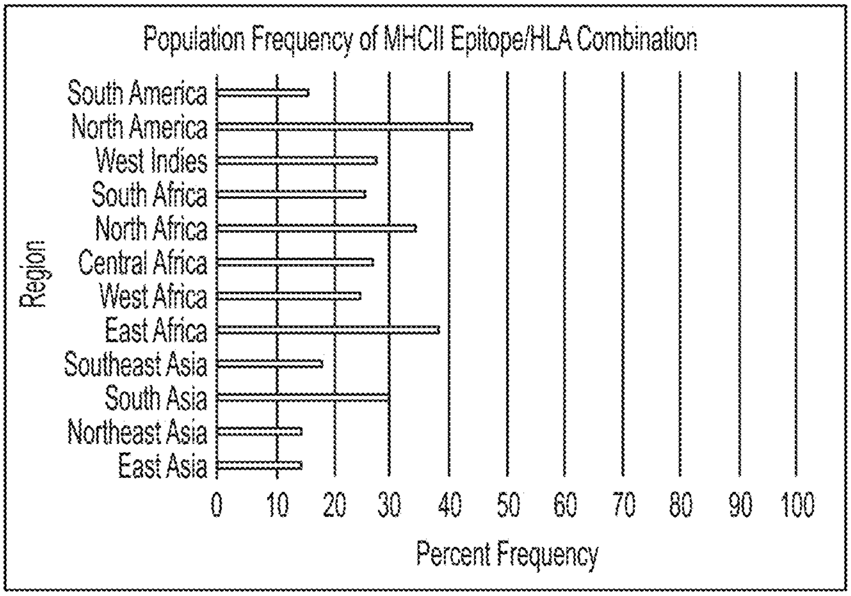
| | | | | | | | | | | | | | | | |
|---|---|---|---|---|---|---|---|---|---|---|---|---|---|---|---|
| 1 | | | | | K | | | | | T | | | | I | |
| 2 | | | | | R | | | | | Q | | | | | |
| 3 | | | | | K | | | | | K | | | | | |
| 4 | | | K | V | R | | E | | | R | I | | | | |
Fig. 17C

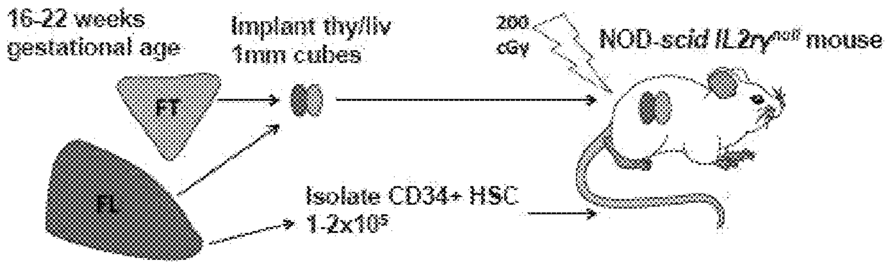
Human CD8 T cells stimulated with peptide epitope
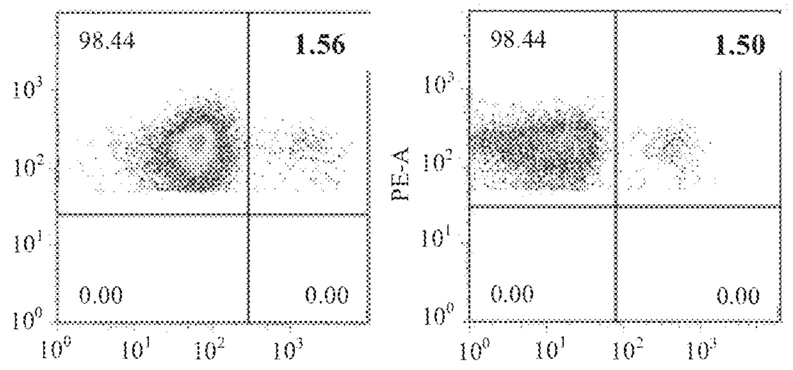
Fig. 20

GENOME

Flavivirus genome

Genomic polyprotein

5' — ——————————————————————— 3'-OH

C | M | E | NS1 | NS2A | NS2B | NS3 | NS4A | NS4B | NS5 prME

↓ Signal peptidase    ↓ Golgi protease    ▽ NS3 protease

Vaccine design # 1

| Artificial signal peptide | PrM | E |

Cleavage Junction Conserved between Dengue and Zika

Vaccine design # 2

| Artificial signal peptide | E |

```
                      610       620       630       640       650       660       670
                        |         |         |         |         |         |         |
KU365780_2015_Brazil  SVGGALNSLGKGIHQIFGAAFKSLFGGMSWFSQILIGTLLMWLGLNTKNGSISLMCLALGGVLIFLSTAVSA  SEQ ID NO: 318
KU365779_2015_Brazil  SVGGALNSLGKGIHQIFGAAFKSLFGGMSWFSQILIGTLLMWLGLNTKNGSISLMCLALGGVLIFLSTAVSA  SEQ ID NO: 319
KU365778_2015_Brazil  SVGGALNSLGKGIHQIFGAAFKSLFGGMSWFSQILIGTLLMWLGLNTKNGSISLMCLALGGVLIFLSTAVSA  SEQ ID NO: 320
AHZ13508_FrenchPoly_  SVGGALNSLGKGIHQIFGAAFKSLFGGMSWFSQILIGTLLMWLGLNTKNGSISLMCLALGGVLIFLSTAVSA  SEQ ID NO: 321
KU365777_2015_Brazil  SVGGALNSLGKGIHQIFGAAFKSLFGGMSWFSQILIGTLLMWLGLNTKNGSISLMCLALGGVLIFLSTAVSA  SEQ ID NO: 322
KU321639_2015_Brazil  SVGGALNSLGKGIHQIFGAAFKSLFGGMSWFSQILIGTLLMWLGLNTKNGSISLMCLALGGVLIFLSTAVSA  SEQ ID NO: 323
KU312312_2015_Surina  SVGGALNSLGKGIHQIFGAAFKSLFGGMSWFSQILIGTLLMWLGLNTKNGSISLMCLALGGVLIFLSTAVSA  SEQ ID NO: 324
ACD75819_Micronesia   SVGGALNSLGKGIHQIFGAAFKSLFGGMSWFSQILIGTLLMWLGLNTKNGSISLMCLALGGVLIFLSTAVSA  SEQ ID NO: 325
Consensus             SVGGALNSLGKGIHQIFGAAFKSLFGGMSWFSQILIGTLLmWLGLNTKNGSISLmCLALGGVLIFLSTAVSA  SEQ ID NO: 326
Prim.cons.            SVGGALNSLGKGIHQIFGAAFKSLFGGMSWFSQILIGTLLMWLGLNTKNGSISLMCLALGGVLIFLSTAVSA  SEQ ID NO: 326
```

Fig. 27 cont.

Anti Zika Human serum- S46- 1:20
Anti Zika Human serum- S02- 1:20
Transfected cells- Secondary antibody only- 5ug/ml.
Untransfected cells – S46+S02 + Secondary antibody – (1:20 + 1:20+ 5ug/mL)

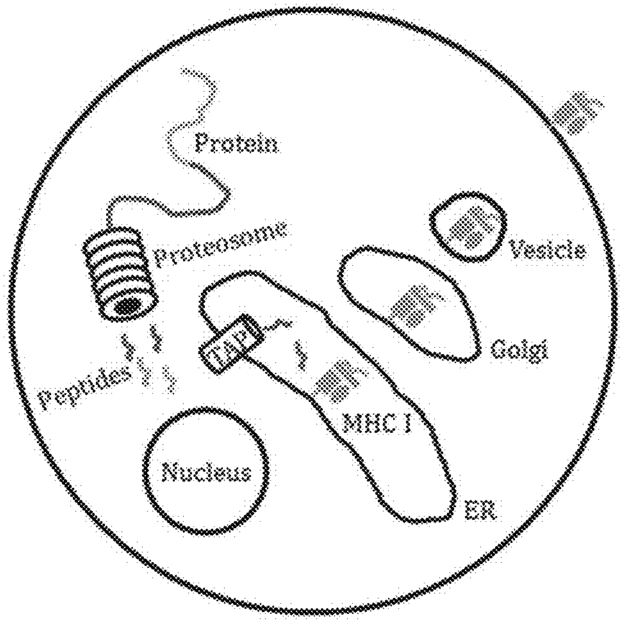
Antigen Presenting Cell (APC)
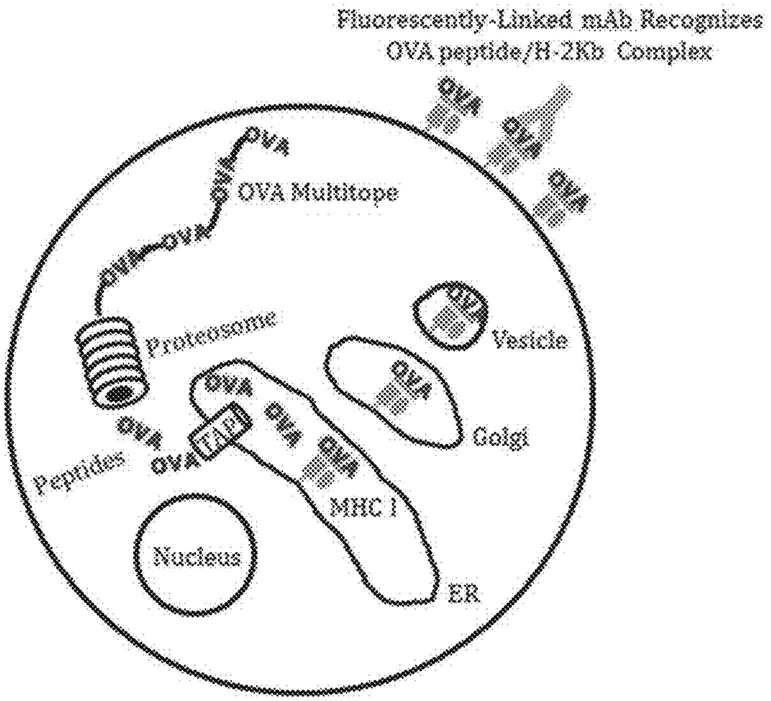
Fig. 35

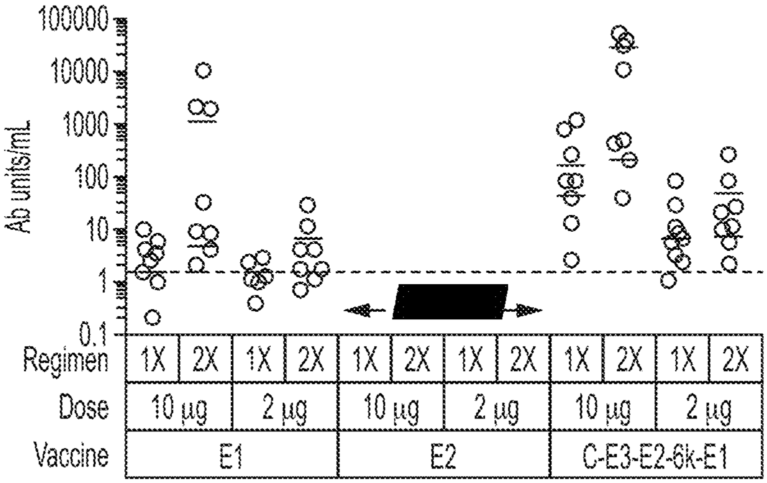
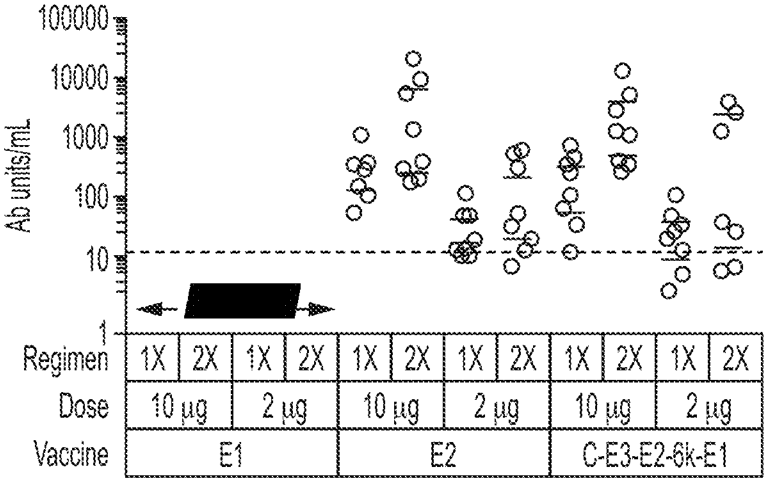
1X dosed day 0, 2X dosed days 0 and 28
Dotted horizontal line represents response in naive control
Fig. 50

Similar Ab responses in the 2 strains of mice (28 days after 1 immunization)
Dotted horizontal line represents response in naive control

CHIKV RNA VACCINES

RELATED APPLICATIONS

This application is a continuation of U.S. application Ser. No. 16/009,880, filed Jun. 15, 2018, which is a continuation of U.S. application Ser. No. 15/746,286, filed Jan. 19, 2018, which is a national stage filing under 35 U.S.C. § 371 of international application number PCT/US2016/043348, filed Jul. 21, 2016, which claims the benefit under 35 U.S.C. § 119(e) of U.S. provisional application No. 62/357,806, filed Jul. 1, 2016, U.S. provisional application No. 62/351,200, filed Jun. 16, 2016, U.S. provisional application No. 62/351,244, filed Jun. 16, 2016, U.S. provisional application No. 62/351,267, filed Jun. 16, 2016, U.S. provisional application No. 62/351,148, filed Jun. 16, 2016, U.S. provisional application No. 62/351,206, filed Jun. 16, 2016, U.S. provisional application No. 62/303,666, filed Mar. 4, 2016, U.S. provisional application No. 62/303,405, filed Mar. 4, 2016, U.S. provisional application No. 62/247,551, filed Oct. 28, 2015, U.S. provisional application No. 62/247,527, filed Oct. 28, 2015, U.S. provisional application No. 62/247,660, filed Oct. 28, 2015, U.S. provisional application No. 62/247,644, filed Oct. 28, 2015, U.S. provisional application No. 62/247,581, filed Oct. 28, 2015, U.S. provisional application No. 62/245,179, filed Oct. 22, 2015, U.S. provisional application No. 62/244,995, filed Oct. 22, 2015, U.S. provisional application No. 62/244,855, filed Oct. 22, 2015, U.S. provisional application No. 62/244,859, filed Oct. 22, 2015, U.S. provisional application No. 62/245,233, filed Oct. 22, 2015, U.S. provisional application No. 62/241,699, filed Oct. 14, 2015, U.S. provisional application No. 62/199,204, filed Jul. 30, 2015, and U.S. provisional application No. 62/195,263, filed Jul. 21, 2015, each of which is incorporated by reference herein in its entirety.

BACKGROUND OF INVENTION

Chikungunya virus (CHIKV) is a mosquito-borne virus belonging to the *Alphavirus* genus of the *Togaviridae* family that was first isolated in 1953 in Tanzania, where the virus was endemic. Outbreaks occur repeatedly in west, central, and southern Africa and have caused several human epidemics in those areas since that time. The virus is passed to humans by two species of mosquito of the genus *Aedes: A. albopictus* and *A. aegypti*. There are several Chikungunya genotypes: Indian Ocean, East/Central/South African (ECSA), Asian, West African, and Brazilian.

Presently, CHIKV is a re-emerging human pathogen that has now established itself in Southeast Asia and has more recently spread to Europe. The Chikungunya virus (CHIKV) was introduced into Asia around 1958, and sites of endemic transmission within Southeastern Asia, including the Indian Ocean, were observed through 1996. The CHIKV epidemic moved throughout Asia, reaching Europe and Africa in the early 2000s, and was imported via travelers to North America and South America from 2005 to 2007. Sporadic outbreaks are still occurring in several countries, such as Italy, inflicting naive populations. Singapore, for instance, experienced two successive waves of Chikungunya virus outbreaks in January and August 2008. Of the two strain lineages of CHIKV, the African strain remains enzootic by cycling between mosquitoes and monkeys, but the Asian strain is transmitted directly between mosquitoes and humans. This cycle of transmission may have allowed the virus to become more pathogenic as the reservoir host was eliminated.

In humans, CHIKV causes a debilitating disease characterized by fever, headache, nausea, vomiting, fatigue, rash, muscle pain and joint pain. Following the acute phase of the illness, patients develop severe chronic symptoms lasting from several weeks to months, including fatigue, incapacitating joint pain and polyarthritis.

The re-emergence of CHIKV has caused millions of cases throughout countries around the Indian Ocean and in Southeast Asia. Specifically, India, Indonesia, Maldives, Myanmar and Thailand have reported over 1.9 million cases since 2005. Globally, human CHIKV epidemics from 2004-2011 have resulted in 1.4-6.5 million reported cases, including a number of deaths. Thus, CHIKV remains a public threat that constitutes a major public health problem with severe social and economic impact.

Despite significant morbidity and some cases of mortality associated with CHIKV infection and its growing prevalence and geographic distribution, there is currently no licensed CHIKV vaccine or antiviral approved for human use. Several potential CHIKV vaccine candidates have been tested in humans and animals with varying success.

Dengue virus (DENV) is a mosquito-borne (*Aedes aegypti/Aedes albopictus*) member of the family Flaviviridae (positive-sense, single-stranded RNA virus). Dengue virus is a positive-sense RNA virus of the *Flavivirus* genus of the Flaviviridae family, which also includes West Nile virus, Yellow Fever Virus, and Japanese Encephalitis virus. It is transmitted to humans through *Stegomyia aegypti* (formerly *Aedes*) mosquito vectors and is mainly found in the tropical and semitropical areas of the world, where it is endemic in Asia, the Pacific region, Africa, Latin America, and the Caribbean. The incidence of infections has increased 30-fold over the last 50 years (WHO, *Dengue: Guidelines for diagnosis, treatment, prevention, and control* (2009)) and Dengue virus is the second most common tropical infectious disease worldwide after malaria.

There is no specific treatment for DENV infection, and control of DENV by vaccination has proved elusive, in part, because the pathogenesis of DHF/DSS is not completely understood. While infection with one serotype confers lifelong homotypic immunity, it confers only short term (approximately three to six months) cross protection against heterotypic serotypes. Also, there is evidence that prior infection with one type can produce an antibody response that can intensify, or enhance, the course of disease during a subsequent infection with a different serotype. The possibility that vaccine components could elicit enhancing antibody responses, as opposed to protective responses, has been a major concern in designing and testing vaccines to protect against dengue infections.

In late 2015 and early 2016, the first dengue vaccine, Dengvaxia (CYD-TDV) by Sanofi Pasteur, was registered in several countries for use in individuals 9-45 years of age living in endemic areas. Issues with the vaccine include (1) weak protection against DENV1 and DENV2 (<60% efficacy); (2) relative risk of dengue hospitalization among children <9 years old (7.5× higher than placebo); (3) immunogenicity not sustained after 1-2 years (implying the need for a $4^{th}$ dose booster); and (4) lowest efficacy against DENV2, which often causes more severe conditions. This latter point is a major weakness with the Dengvaxia vaccine, signaling the need of a new, more effective vaccine effective against DENV2. Other tetravalent live-attenuated vaccines are under development in phase II and phase III clinical trials, and other vaccine candidates (based on subunit, DNA and purified inactivated virus platforms) are at earlier stages of clinical development, although the ability of these vaccine candidates to provide broad serotype protection has not been demonstrated.

Zika virus (ZIKV) is a member of the Flaviviridae virus family and the flavivirus genus. In humans, it causes a disease known as Zika fever. It is related to dengue, yellow fever, West Nile and Japanese encephalitis, viruses that are also members of the virus family Flaviviridae. ZIKV is spread to people through mosquito bites. The most common symptoms of ZIKV disease (Zika) are fever, rash, joint pain, and red eye. The illness is usually mild with symptoms lasting from several days to a week. There is no vaccine to prevent, or medicine to treat, Zika virus.

Deoxyribonucleic acid (DNA) vaccination is one technique used to stimulate humoral and cellular immune responses to foreign antigens, such as ZIKV antigens. The direct injection of genetically engineered DNA (e.g., naked plasmid DNA) into a living host results in a small number of its cells directly producing an antigen, resulting in a protective immunological response. With this technique, however, comes potential problems, including the possibility of insertional mutagenesis, which could lead to the activation of oncogenes or the inhibition of tumor suppressor genes.

SUMMARY OF INVENTION

Provided herein is a ribonucleic acid (RNA) vaccine (e.g., messenger RNA (mRNA)) that can safely direct the body's cellular machinery to produce nearly any protein of interest, from native proteins to antibodies and other entirely novel protein constructs that can have therapeutic activity inside and outside of cells. The RNA vaccines of the present disclosure may be used to induce a balanced immune response against a single virus or multiple viruses, including Chikungunya virus (CHIKV), Zika Virus (ZIKV) and Dengue virus (DENV), comprising both cellular and humoral immunity, without the associated safety concerns, e.g., risking the possibility of insertional mutagenesis.

Some embodiments of the present disclosure provide vaccines and/or combination vaccines comprising one or more RNA polynucleotides, e.g., mRNA. In some embodiments, the RNA polynucleotide(s) encode a CHIKV antigen, a ZIKV antigen, a DENV antigen, or any combination of two or three of the foregoing (e.g., CHIKV antigen/ZIKV antigen, CHIKV antigen/DENV antigen, ZIKV antigen/DENV antigen, or CHIKV/DENV/ZIKV) on either the same polynucleotide or different polynucleotides. In some embodiments, the RNA polynucleotide(s) encode a ZIKV antigen and a DENV antigen, on either the same polynucleotide or different polynucleotides.

Thus, it should be understood the phrase "a CHIKV, DENV and/or ZIKV" is intended to encompass each individual virus in the alternative (CHIKV or DENV or ZIKV) as well as the individual combinations of CHIKV and DENV (CHIKV/DENV), CHIKV and ZIKV (CHIKV/ZIKV), ZIKV and DENV (ZIKV/DENV), and CHIKV, DENV and ZIKV (CHIKV/DENV/ZIKV).

In some aspects, the present disclosure provides a vaccine or a combination vaccine of at least one RNA polynucleotide encoding at least one CHIKV antigenic polypeptide, at least one ZIKV antigenic polypeptide, at least one DENV antigenic polypeptide, or a combination of any two or three of the foregoing, and a pharmaceutically acceptable carrier or excipient. In some embodiments, the RNA polynucleotides encoding the DENV antigenic polypeptide, the ZIKV antigenic polypeptide and/or the CHIKV antigenic polypeptide are mono-cistronic RNA polynucleotides. In other embodiments, the RNA polynucleotide encoding the DENV antigenic polypeptide, the ZIKV antigenic polypeptide and/or the CHIKV antigenic polypeptide is a poly-cistronic. In other embodiments, the RNA polynucleotides include combinations of mono-cistronic and poly-cistronic RNA.

In some aspects, the present disclosure provides a vaccine or a combination vaccine of at least one RNA polynucleotide encoding at least one ZIKV antigenic polypeptide and at least one DENV antigenic polypeptide and a pharmaceutically acceptable carrier or excipient. In some embodiments, the RNA polynucleotides encoding the ZIKV antigenic polypeptide and the DENV antigenic polypeptide are mono-cistronic RNA polynucleotides. In other embodiments, the RNA polynucleotide encoding the ZIKV antigenic polypeptide and the DENV antigenic polypeptide is a poly-cistronic RNA polynucleotide. In other embodiments, the RNA polynucleotides include combinations of mono-cistronic and poly-cistronic RNA.

In some aspects, the present disclosure provides a vaccine or a combination vaccine of at least one RNA polynucleotide encoding at least one ZIKV antigenic polypeptide and at least one CHIKV antigenic polypeptide and a pharmaceutically acceptable carrier or excipient. In some embodiments, the RNA polynucleotides encoding the ZIKV antigenic polypeptide and the CHIKV antigenic polypeptide are mono-cistronic RNA polynucleotides. In other embodiments, the RNA polynucleotide encoding the ZIKV antigenic polypeptide and the CHIKV antigenic polypeptide is a poly-cistronic RNA polynucleotide. In other embodiments, the RNA polynucleotides include combinations of mono-cistronic and poly-cistronic RNA.

In some aspects, the present disclosure provides a vaccine or a combination vaccine of at least one RNA polynucleotide encoding at least one DENV antigenic polypeptide and at least one CHIKV antigenic polypeptide and a pharmaceutically acceptable carrier or excipient. In some embodiments, the RNA polynucleotides encoding the DENV antigenic polypeptide and the CHIKV antigenic polypeptide are mono-cistronic RNA polynucleotides. In other embodiments, the RNA polynucleotide encoding the DENV antigenic polypeptide and the CHIKV antigenic polypeptide is a poly-cistronic RNA polynucleotide. In other embodiments, the RNA polynucleotides include combinations of mono-cistronic and poly-cistronic RNA.

The at least one RNA polynucleotide, e.g., mRNA, in some embodiments, encodes two or more CHIKV antigenic polypeptides, two or more ZIKV antigenic polypeptides or two or more DENV antigenic polypeptides. The at least one RNA polynucleotide, e.g., mRNA, in some embodiments, encodes two or more CHIKV antigenic polypeptides, two or more ZIKV antigenic polypeptides and two or more DENV antigenic polypeptides. In some embodiments, the at least one RNA polynucleotide, e.g., mRNA, encodes two or more ZIKV antigenic polypeptides and two or more DENV antigenic polypeptides. In some embodiments, the at least one RNA polynucleotide, e.g., mRNA, encodes two or more ZIKV antigenic polypeptides and two or more CHIKV antigenic polypeptides. In some embodiments, the at least one RNA polynucleotide, e.g., mRNA, encodes two or more CHIKV antigenic polypeptides and two or more DENV antigenic polypeptides.

The CHIKV antigenic polypeptide may be a Chikungunya structural protein or an antigenic fragment or epitope thereof. The DENV antigenic polypeptide may be a Dengue virus (DENV) structural protein or an antigenic fragment or epitope thereof. The ZIKV antigenic polypeptide may be a Zika virus (ZIKV) structural protein (e.g., polyprotein) or an antigenic fragment or epitope thereof.

In some embodiments, the antigenic polypeptide is a CHIKV structural protein or an antigenic fragment thereof. For example, a CHIKV structural protein may be an envelope protein (E), a 6K protein, or a capsid (C) protein. In some embodiments, the CHIKV structural protein is an envelope protein selected from E1, E2, and E3. In some embodiments, the CHIKV structural protein is E1 or E2. In some embodiments, the CHIKV structural protein is a capsid protein. In some embodiments, the antigenic polypeptide is a fragment or epitope of a CHIKV structural protein.

In some embodiments, at least one antigenic polypeptide is a ZIKV polyprotein. In some embodiments, at least one antigenic polypeptide is a ZIKV structural polyprotein. In some embodiments, at least one antigenic polypeptide is a ZIKV nonstructural polyprotein.

In some embodiments, at least one antigenic polypeptide is a ZIKV capsid protein, a ZIKV premembrane/membrane protein, a ZIKV envelope protein, a ZIKV non-structural protein 1, a ZIKV non-structural protein 2A, a ZIKV non-structural protein 2B, a ZIKV non-structural protein 3, a ZIKV non-structural protein 4A, a ZIKV non-structural protein 4B, or a ZIKV non-structural protein 5.

In some embodiments, at least one antigenic polypeptide is a ZIKV capsid protein, a ZIKV premembrane/membrane protein, a ZIKV envelope protein, a ZIKV non-structural protein 1, a ZIKV non-structural protein 2A, a ZIKV non-structural protein 2B, a ZIKV non-structural protein 3, a ZIKV non-structural protein 4A, a ZIKV non-structural protein 4B, or a ZIKV non-structural protein 5.

In some embodiments, the vaccine comprises a RNA polynucleotide having an open reading frame encoding a ZIKV capsid protein, a RNA polynucleotide having an open reading frame encoding a ZIKV premembrane/membrane protein, and a RNA polynucleotide having an open reading frame encoding a ZIKV envelope protein.

In some embodiments, the vaccine comprises a RNA polynucleotide having an open reading frame encoding a ZIKV capsid protein and a RNA polynucleotide having an open reading frame encoding a ZIKV premembrane/membrane protein.

In some embodiments, the vaccine comprises a RNA polynucleotide having an open reading frame encoding a ZIKV capsid protein and a RNA polynucleotide having an open reading frame encoding a ZIKV envelope protein.

In some embodiments, the vaccine comprises a RNA polynucleotide having an open reading frame encoding a ZIKV premembrane/membrane protein and a RNA polynucleotide having an open reading frame encoding a ZIKV envelope protein.

In some embodiments, the vaccine comprises a RNA polynucleotide having an open reading frame encoding a ZIKV capsid protein and at least one RNA polynucleotide having an open reading frame encoding any one or more of a ZIKV non-structural protein 1, 2A, 2B, 3, 4A, 4B or 5.

In some embodiments, the vaccine comprises a RNA polynucleotide having an open reading frame encoding a ZIKV premembrane/membrane protein and at least one RNA polynucleotide having an open reading frame encoding any one or more of a ZIKV non-structural protein 1, 2A, 2B, 3, 4A, 4B or 5.

In some embodiments, the vaccine comprises a RNA polynucleotide having an open reading frame encoding a ZIKV envelope protein and at least one RNA polynucleotide having an open reading frame encoding any one or more of a ZIKV non-structural protein 1, 2A, 2B, 3, 4A, 4B or 5.

In some embodiments, the at least one antigenic polypeptide comprises a combination of any two or more of a ZIKV capsid protein, a ZIKV premembrane/membrane protein, a ZIKV envelope protein, a ZIKV non-structural protein 1, a ZIKV non-structural protein 2A, a ZIKV non-structural protein 2B, a ZIKV non-structural protein 3, a ZIKV non-structural protein 4A, a ZIKV non-structural protein 4B, or a ZIKV non-structural protein 5.

In some embodiments, the at least one ZIKV antigenic polypeptide is fused to signal peptide having a sequence set forth as SEQ ID NO: 125, 126, 128 or 131. In some embodiments, the signal peptide is fused to the N-terminus of the at least one ZIKV antigenic polypeptide.

In some embodiments, the antigenic polypeptide comprises two or more CHIKV structural proteins. In some embodiments, the two or more CHIKV structural proteins are envelope proteins. In some embodiments, the two or more CHIKV structural proteins are E1 and E2. In some embodiments, the two or more CHIKV structural proteins are E1 and E3. In some embodiments, the two or more CHIKV structural proteins are E2 and E3. In some embodiments, the two or more CHIKV structural proteins are E1, E2, and E3. In some embodiments, the two or more CHIKV structural proteins are envelope and capsid proteins. In some embodiments, the two or more CHIKV structural proteins are E1 and C. In some embodiments, the two or more CHIKV structural proteins are E2 and C. In some embodiments, the two or more CHIKV structural proteins are E3 and C. In some embodiments, the two or more CHIKV structural proteins are E1, E2, and C. In some embodiments, the two or more CHIKV structural proteins are E1, E3, and C. In some embodiments, the two or more CHIKV structural proteins are E2, E3, and C. In some embodiments, the two or more CHIKV structural proteins are E1, E2, E3, and C. In some embodiments, the two or more CHIKV structural proteins are E1, 6K, and E2. In some embodiments, the two or more CHIKV structural proteins are E2, 6K, and E3. In some embodiments, the two or more CHIKV structural proteins are E1, 6K, and E3. In some embodiments, the two or more CHIKV structural proteins are E1, E2, E3, 6K, and C. In some embodiments, the antigenic polypeptide comprises the CHIKV structural polyprotein comprising C, E3, E2, 6K, and E1. In some embodiments, the antigenic polypeptide is a fragment or epitope of two or more CHIKV structural proteins or a fragment or epitope of the polyprotein.

In some embodiments the at least one antigenic polypeptide has greater than 90% identity to an amino acid sequence of any one of Tables 13, 15, 18-27, 32 or 34-37, or any one of SEQ ID NO: 14 or 37-47 (CHIKV), 15, 17, 19, 21, 23, 26, 29, 32, 162-298 (DENV), or 67-134 (ZIKV) and has membrane fusion activity. In some embodiments the at least one CHIKV antigenic polypeptide has greater than 90% identity to an amino acid sequence of any one of SEQ ID NO: 14 or 37-47 and has membrane fusion activity. In some embodiments the at least one DENV antigenic polypeptide has greater than 90% identity to an amino acid sequence of any one of SEQ ID NO: 15, 17, 19, 21, 23, 26, 29, 32, 162-298 and has membrane fusion activity. In some embodiments the at least one ZIKV antigenic polypeptide has greater than 90% identity to an amino acid sequence of any one of SEQ ID NO: 67-134 and has membrane fusion activity.

In some embodiments the at least one antigenic polypeptide has greater than 95% identity to an amino acid sequence of any one of Tables 13, 15, 18-27, 32 or 34-37, or any one of SEQ ID NO: 14 or 37-47 (CHIKV), 15, 17, 19, 21, 23, 26, 29, 32, 162-298 (DENV), or 67-134 (ZIKV) and has membrane fusion activity. In some embodiments the at least one CHIKV antigenic polypeptide has greater than 95% identity to an amino acid sequence of any one of SEQ ID NO: 14 or 37-47 and has membrane fusion activity. In some embodiments the at least one DENV antigenic polypeptide has greater than 95% identity to an amino acid sequence of any one of SEQ ID NO: 15, 17, 19, 21, 23, 26, 29, 32, or 162-298 and has membrane fusion activity. In some embodiments the at least one ZIKV antigenic polypeptide has greater than 95% identity to an amino acid sequence of any one of SEQ ID NO: 67-134 and has membrane fusion activity.

In some embodiments the at least one antigenic polypeptide has greater than 96% identity to an amino acid sequence of any one of Tables 13, 15, 18-27, 32 or 34-37, or any one of SEQ ID NO: 14 or 37-47 (CHIKV), 15, 17, 19, 21, 23, 26, 29, 32, 162-298 (DENV), or 67-134 (ZIKV) and has membrane fusion activity. In some embodiments the at least one CHIKV antigenic polypeptide has greater than 96% identity to an amino acid sequence of any one of SEQ ID NO: 14 or 37-47 and has membrane fusion activity. In some embodiments the at least one DENV antigenic polypeptide has greater than 96% identity to an amino acid sequence of any one of SEQ ID NO: 15, 17, 19, 21, 23, 26, 29, 32, or 162-298 and has membrane fusion activity. In some embodiments the at least one ZIKV antigenic polypeptide has greater than 96% identity to an amino acid sequence of any one of SEQ ID NO: 67-134 and has membrane fusion activity.

In some embodiments the at least one antigenic polypeptide has greater than 97% identity to an amino acid sequence of any one of Tables 13, 15, 18-27, 32 or 34-37, or any one of SEQ ID NO: 14 or 37-47 (CHIKV), 15, 17, 19, 21, 23, 26, 29, 32, 162-298 (DENV), or 67-134 (ZIKV) and has membrane fusion activity. In some embodiments the at least one CHIKV antigenic polypeptide has greater than 97% identity to an amino acid sequence of any one of SEQ ID NO: 14 or 37-47 and has membrane fusion activity. In some embodiments the at least one DENV antigenic polypeptide has greater than 97% identity to an amino acid sequence of any one of SEQ ID NO: 15, 17, 19, 21, 23, 26, 29, 32, or 162-298 and has membrane fusion activity. In some embodiments the at least one ZIKV antigenic polypeptide has greater than 97% identity to an amino acid sequence of any one of SEQ ID NO: 67-134 and has membrane fusion activity.

In some embodiments the at least one antigenic polypeptide has greater than 98% identity to an amino acid sequence of any one of Tables 13, 15, 18-27, 32 or 34-37, or any one of SEQ ID NO: 14 or 37-47 (CHIKV), 15, 17, 19, 21, 23, 26, 29, 32, 162-298 (DENV), or 67-134 (ZIKV) and has membrane fusion activity. In some embodiments the at least one CHIKV antigenic polypeptide has greater than 98% identity to an amino acid sequence of any one of SEQ ID NO: 14 or 37-47 and has membrane fusion activity. In some embodiments the at least one DENV antigenic polypeptide has greater than 98% identity to an amino acid sequence of any one of SEQ ID NO: 15, 17, 19, 21, 23, 26, 29, 32, or 162-298 and has membrane fusion activity. In some embodiments the at least one ZIKV antigenic polypeptide has greater than 98% identity to an amino acid sequence of any one of SEQ ID NO: 67-134 and has membrane fusion activity.

In some embodiments the at least one antigenic polypeptide has greater than 99% identity to an amino acid sequence of any one of Tables 13, 15, 18-27, 32 or 34-37, or any one of SEQ ID NO: 14 or 37-47 (CHIKV), 15, 17, 19, 21, 23, 26, 29, 32, 162-298 (DENV), or 67-134 (ZIKV) and has membrane fusion activity. In some embodiments the at least one CHIKV antigenic polypeptide has greater than 99% identity to an amino acid sequence of any one of SEQ ID NO: 14 or 37-47 and has membrane fusion activity. In some embodiments the at least one DENV antigenic polypeptide has greater than 99% identity to an amino acid sequence of any one of SEQ ID NO: 15, 17, 19, 21, 23, 26, 29, 32, or 162-298 and has membrane fusion activity. In some embodiments the at least one ZIKV antigenic polypeptide has greater than 99% identity to an amino acid sequence of any one of SEQ ID NO: 67-134 and has membrane fusion activity.

In some embodiments the at least one antigenic polypeptide has greater than 95-99% identity to an amino acid sequence of any one of Tables 13, 15, 18-27, 32 or 34-37, or any one of SEQ ID NO: 14 or 37-47 (CHIKV), 15, 17, 19, 21, 23, 26, 29, 32, 162-298 (DENV), or 67-134 (ZIKV) and has membrane fusion activity. In some embodiments the at least one CHIKV antigenic polypeptide has greater than 95-99% identity to an amino acid sequence of any one of SEQ ID NO: 14 or 37-47 and has membrane fusion activity. In some embodiments the at least one DENV antigenic polypeptide has greater than 95-99% identity to an amino acid sequence of any one of SEQ ID NO: 15, 17, 19, 21, 23, 26, 29, 32, or 162-298 and has membrane fusion activity. In some embodiments the at least one ZIKV antigenic polypeptide has greater than 95-99% identity to an amino acid sequence of any one of SEQ ID NO: 67-134 and has membrane fusion activity.

In other embodiments the at least one antigenic polypeptides encode an antigenic polypeptide having an amino acid sequence of Tables 13, 15, 18-27, 32 or 34-37, or any one of SEQ ID NO: 14 or 37-47 (CHIKV), 15, 17, 19, 21, 23, 26, 29, 32, 162-298 (DENV), or 67-134 (ZIKV) and wherein the RNA polynucleotide is codon optimized mRNA. In yet other embodiments the at least one antigenic polypeptide has an amino acid sequence of Tables 13, 15, 18-27, 32 or 34-37, or any one of SEQ ID NO: 14 or 37-47 (CHIKV), 15, 17, 19, 21, 23, 26, 29, 32, 162-298 (DENV), or 67-134 (ZIKV) and wherein the RNA polynucleotide has less than 80% identity to wild-type mRNA sequence. According to some embodiments the at least one antigenic polypeptide has an amino acid sequence of Tables 13, 15, 18-27, 32 or 34-37, or any one of SEQ ID NO: 14 or 37-47 (CHIKV), 15, 17, 19, 21, 23, 26, 29, 32, 162-298 (DENV), or 67-134 (ZIKV) and wherein the RNA polynucleotide has greater than 80% identity to wild-type mRNA sequence, but does not include wild-type mRNA sequence.

In some embodiments, the DENV antigen is a concatemeric DENV antigen. In some embodiments, the DENV concatemeric antigen comprises between 2-100 DENV peptide epitopes connected directly to one another or interspersed by linkers. In some embodiments, the DENV vaccine's peptide epitopes are T cell epitopes and/or B cell epitopes. In other embodiments, the DENV vaccine's peptide epitopes comprise a combination of T cell epitopes and B cell epitopes. In some embodiments, at least one of the peptide epitopes of the DENV vaccine is a T cell epitope. In some embodiments, at least one of the peptide epitopes of the DENV vaccine is a B cell epitope. In some embodiments, the T cell epitope of the DENV vaccine comprises between 8-11 amino acids. In some embodiments, the B cell epitope of the DENV vaccine comprises between 13-17 amino acids.

In some embodiments, the RNA polynucleotide, e.g., mRNA, of a vaccine is encoded by at least one polynucleotide comprising a nucleotide sequence having at least 80%, 85%, 90%, 95%, 98% or 99% identity to any of the nucleotide sequences of Tables 1-4, 13, 15, 31, 34 or 38, or any one of SEQ ID NO: 1-13 (CHIKV), 16, 18, 20, 22, 24, 25, 27, 28, 30, 31, 33, 34, 144-152 or 199-212 (DENV), or 48-66 (ZIKV). In some embodiments, the RNA polynucleotide, e.g., mRNA, of a vaccine is encoded by at least one polynucleotide comprising a nucleotide sequence having at least 80%, 85%, 90%, 95%, 98% or 99% identity to any of the CHIKV nucleotide sequences of SEQ ID NO: 1-13. In some embodiments, the RNA polynucleotide, e.g., mRNA, of a vaccine is encoded by at least one polynucleotide comprising a nucleotide sequence having at least 80%, 85%, 90%, 95%, 98% or 99% identity to any of the DENV nucleotide sequences of SEQ ID NO: 16, 18, 20, 22, 24, 25, 27, 28, 30, 31, 33, 34, 144-152 or 199-212. In some embodiments, the RNA polynucleotide, e.g., mRNA, of a vaccine is encoded by at least one polynucleotide comprising a nucleotide sequence having at least 80%, 85%, 90%, 95%, 98% or 99% identity to any of the ZIKV nucleotide sequences of SEQ ID NO: 67-134.

In other embodiments, the RNA polynucleotide comprises a polynucleotide sequence derived from an Asian strain, Brazilian strain, West African strain, ECSA strain, and Indian Ocean strain of Chikungunya.

In some embodiments, at least one antigenic polypeptide is a ZIKV envelope protein.

In some embodiments, at least one antigenic polypeptide is a Spondweni virus Polyprotein.

In some embodiments, at least one antigenic polypeptide is a polyprotein obtained from ZIKV strain MR 766, ACD75819 or SPH2015.

In some embodiments, at least one antigenic polypeptide has an amino acid sequence of any one of the sequences listed in Table 32.

In some embodiments, at least one antigenic polypeptide has at least 95% identity to an antigenic polypeptide having an amino acid sequence of any one of the sequences listed in Table 32.

In some embodiments, the at least one RNA polynucleotide encodes at least one antigenic polypeptide having a sequence of listed in Table 31.

In some embodiments, the at least one RNA polynucleotide encodes at least one protein variant having at least 95% identity to an antigenic polypeptide having a sequence of listed in Table 31.

Tables herein provide National Center for Biotechnology Information (NCBI) accession numbers of interest. It should be understood that the phrase "an amino acid sequence of Table X" (e.g., Table 33 or Table 35) refers to an amino acid sequence identified by one or more NCBI accession numbers listed in Table X. Each of the amino acid sequences, and variants having greater than 95% identity to each of the amino acid sequences encompassed by the accession numbers of Table X (e.g., Table 33 or Table 35) are included within the constructs of the present disclosure.

In some embodiments, at least one RNA polynucleotide encodes an antigenic polypeptide having at least 90% identity to an amino acid sequence of Table 32 or 33 Table 32 or 33 and having membrane fusion activity. In some embodiments, at least one RNA polynucleotide encodes an antigenic polypeptide having at least 95% identity to an amino acid sequence of Table 32 or 33 and having membrane fusion activity. In some embodiments, at least one RNA polynucleotide encodes an antigenic polypeptide having at least 96% identity to an amino acid sequence of Table 32 or 33 and having membrane fusion activity. In some embodiments, at least one RNA polynucleotide encodes an antigenic polypeptide having at least 97% identity to an amino acid sequence of Table 32 or 33 and having membrane fusion activity. In some embodiments, at least one RNA polynucleotide encodes an antigenic polypeptide having at least 98% identity to an amino acid sequence of Table 32 or 33 and having membrane fusion activity. In some embodiments, at least one RNA polynucleotide encodes an antigenic polypeptide having at least 99% identity to an amino acid sequence of Table 32 or 33 and having membrane fusion activity. In some embodiments, at least one RNA polynucleotide encodes an antigenic polypeptide having 95-99% identity to an amino acid sequence of Table 32 or 33 and having membrane fusion activity.

In some embodiments, at least one RNA polynucleotide encodes an antigenic polypeptide having an amino acid sequence of Table 32 or 33 and is codon optimized mRNA.

In some embodiments, at least one RNA polynucleotide encodes an antigenic polypeptide having an amino acid sequence of Table 32 or 33 and has less than 80% identity to wild-type mRNA sequence. In some embodiments, at least one RNA polynucleotide encodes an antigenic polypeptide having an amino acid sequence of Table 32 or 33 and has less than 75%, 85% or 95% identity to wild-type mRNA sequence. In some embodiments, at least one RNA polynucleotide encodes an antigenic polypeptide having an amino acid sequence of Table 32 or 33 and has 50-80%, 60-80%, 40-80%, 30-80%, 70-80%, 75-80% or 78-80% identity to wild-type mRNA sequence. In some embodiments, at least one RNA polynucleotide encodes an antigenic polypeptide having an amino acid sequence of Table 32 or 33 and has 40-85%, 50-85%, 60-85%, 30-85%, 70-85%, 75-85%, or 80-85% identity to wild-type mRNA sequence. In some embodiments, at least one RNA polynucleotide encodes an antigenic polypeptide having an amino acid sequence of Table 32 or 33 and has 40-90%, 50-90%, 60-90%, 30-90%, 70-90%, 75-90%, 80-90%, or 85-90% identity to wild-type mRNA sequence.

In some embodiments, at least one RNA polynucleotide is encoded by a nucleic acid having at least 90% identity to a nucleic acid sequence of Table 31. In some embodiments, at least one RNA polynucleotide is encoded by a nucleic acid having at least 95% identity to a nucleic acid sequence of Table 31. In some embodiments, at least one RNA polynucleotide is encoded by a nucleic acid having at least 96% identity to a nucleic acid sequence of Table 31. In some embodiments, at least one RNA polynucleotide is encoded by a nucleic acid having at least 97% identity to a nucleic acid sequence of Table 31. In some embodiments, at least one RNA polynucleotide is encoded by a nucleic acid having at least 98% identity to a nucleic acid sequence of Table 31. In some embodiments, at least one RNA polynucleotide is encoded by a nucleic acid having at least 99% identity to a nucleic acid sequence of Table 31. In some embodiments, at least one RNA polynucleotide is encoded by a nucleic acid having 95-99% identity to a nucleic acid sequence of Table 31.

In some embodiments, at least one mRNA polynucleotide is encoded by a nucleic acid having a sequence of Table 31 and has less than 80% identity to wild-type mRNA sequence. In some embodiments, at least one mRNA polynucleotide is encoded by a nucleic acid having a sequence of Table 31 and has less than 75%, 85% or 95% identity to a wild-type mRNA sequence. In some embodiments, at least one mRNA polynucleotide is encoded by a nucleic acid having a sequence of Table 31 and has less than 50-80%, 60-80%, 40-80%, 30-80%, 70-80%, 75-80% or 78-80% identity to wild-type mRNA sequence. In some embodiments, at least one mRNA polynucleotide is encoded by a nucleic acid having a sequence of Table 31 and has less than 40-85%, 50-85%, 60-85%, 30-85%, 70-85%, 75-85% or 80-85% identity to wild-type mRNA sequence. In some embodiments, at least one mRNA polynucleotide is encoded by a nucleic acid having a sequence of Table 31 and has less than 40-90%, 50-90%, 60-90%, 30-90%, 70-90%, 75-90%, 80-90%, or 85-90% identity to wild-type mRNA sequence.

In some embodiments, at least one RNA polynucleotide encodes an antigenic polypeptide having an amino acid sequence of Table 32 or 33 and having at least 80% identity to wild-type mRNA sequence, but does not include wild-type mRNA sequence.

In some embodiments, at least one RNA polynucleotide encodes an antigenic polypeptide that attaches to cell receptors.

In some embodiments, at least one RNA polynucleotide encodes an antigenic polypeptide that causes fusion of viral and cellular membranes.

In some embodiments, at least one RNA polynucleotide encodes an antigenic polypeptide that is responsible for binding of the ZIKV to a cell being infected.

Some embodiments of the present disclosure provide a CHIKV vaccine that includes at least one RNA polynucleotide having an open reading frame encoding a CHIKV antigenic polypeptides, in which the RNA polynucleotide of the CHIKV vaccine includes a 5' terminal cap. Some embodiments of the present disclosure provide a DENV vaccine that includes at least one RNA polynucleotide having an open reading frame encoding a DENV antigenic polypeptides, in which the RNA polynucleotide of the DENV vaccine includes a 5' terminal cap. Some embodiments of the present disclosure provide a ZIKV vaccine that includes at least one RNA polynucleotide having an open reading frame encoding a ZIKV antigenic polypeptides, in which the RNA polynucleotide of the ZIKV vaccine includes a 5' terminal cap.

Some embodiments of the present disclosure provide a CHIKV/DENV/ZIKV combination vaccine that includes at least one RNA polynucleotide having an open reading frame encoding at least one each of CHIKV, DENV, and ZIKV antigenic polypeptides, in which the RNA polynucleotide of the CHIKV, DENV, and ZIKV RNA vaccine includes a 5' terminal cap. Some embodiments of the present disclosure provide a DENV/ZIKV combination vaccine that includes at least one RNA polynucleotide having an open reading frame encoding at least one each of DENV and ZIKV antigenic polypeptides, in which the RNA polynucleotide of the DENV, and ZIKV RNA vaccine includes a 5' terminal cap. Some embodiments of the present disclosure provide a CHIKV/ZIKV combination vaccine that includes at least one RNA polynucleotide having an open reading frame encoding at least one each of CHIKV and ZIKV antigenic polypeptides, in which the RNA polynucleotide of the CHIKV and ZIKV RNA vaccine includes a 5' terminal cap. Some embodiments of the present disclosure provide a CHIKV/DENV combination vaccine that includes at least one RNA polynucleotide having an open reading frame encoding at least one each of CHIKV and DENV antigenic polypeptides, in which the RNA polynucleotide of the CHIKV and DENV RNA vaccine includes a 5' terminal cap. In some embodiments, the 5' terminal cap is 7 mG(5')ppp (5')NlmpNp.

Some embodiments of the present disclosure provide a vaccine that includes at least one RNA polynucleotide having an open reading frame encoding at least one CHIKV antigenic polypeptide in which the RNA polynucleotide of the CHIKV RNA vaccine includes at least one chemical modification. Some embodiments of the present disclosure provide a vaccine that includes at least one RNA polynucleotide having an open reading frame encoding at least one DENV antigenic polypeptide in which the RNA polynucleotide of the DENV RNA vaccine includes at least one chemical modification. Some embodiments of the present disclosure provide a vaccine that includes at least one RNA polynucleotide having an open reading frame encoding at least one ZIKV antigenic polypeptide in which the RNA polynucleotide of the ZIKV RNA vaccine includes at least one chemical modification.

Some embodiments of the present disclosure provide a combination vaccine that includes at least one RNA polynucleotide having an open reading frame encoding at least one CHIKV antigenic polypeptide, at least one DENV antigenic polypeptide, and at least one ZIKV antigenic polypeptide in which the RNA polynucleotide of the CHIKV/DENV/ZIKV combination RNA vaccine includes at least one chemical modification. Some embodiments of the present disclosure provide a combination vaccine that includes at least one RNA polynucleotide having an open reading frame encoding at least one CHIKV antigenic polypeptide and at least one DENV antigenic polypeptide in which the RNA polynucleotide of the CHIKV/DENV combination RNA vaccine includes at least one chemical modification. Some embodiments of the present disclosure provide a combination vaccine that includes at least one RNA polynucleotide having an open reading frame encoding at least one CHIKV antigenic polypeptide and at least one ZIKV antigenic polypeptide in which the RNA polynucleotide of the CHIKV/ZIKV combination RNA vaccine includes at least one chemical modification. Some embodiments of the present disclosure provide a combination vaccine that includes at least one RNA polynucleotide having an open reading frame encoding at least one DENV antigenic polypeptide and at least one ZIKV antigenic polypeptide in which the RNA polynucleotide of the DENV/ZIKV combination RNA vaccine includes at least one chemical modification.

In some embodiments, the chemical modification is selected from pseudouridine, N1-methylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine, 5-methyluridine, and 2'-O-methyl uridine.

In some embodiments, the RNA polynucleotide, e.g., mRNA including at least one chemical modification further includes a 5' terminal cap. In some embodiments, the 5' terminal cap is 7 mG(5')ppp(5')NlmpNp.

Some embodiments of the present disclosure provide a vaccine that includes at least one RNA polynucleotide having an open reading frame encoding at least one CHIKV antigenic polypeptide, wherein at least 80% of the uracil in the open reading frame have a chemical modification. Some embodiments of the present disclosure provide a vaccine that includes at least one RNA polynucleotide having an open reading frame encoding at least one DENV antigenic polypeptide, wherein at least 80% of the uracil in the open reading frame have a chemical modification. Some embodiments of the present disclosure provide a vaccine that includes at least one RNA polynucleotide having an open reading frame encoding at least one ZIKV antigenic polypeptide, wherein at least 80% of the uracil in the open reading frame have a chemical modification.

Some embodiments of the present disclosure provide a combination vaccine that includes at least one RNA polynucleotide having an open reading frame encoding at least one CHIKV antigenic polypeptide and at least one DENV antigenic polypeptide, wherein at least 80% of the uracil in the open reading frame have a chemical modification. Some embodiments of the present disclosure provide a combination vaccine that includes at least one RNA polynucleotide having an open reading frame encoding at least one CHIKV antigenic polypeptide and at least one ZIKV antigenic polypeptide, wherein at least 80% of the uracil in the open reading frame have a chemical modification. Some embodiments of the present disclosure provide a combination vaccine that includes at least one RNA polynucleotide having an open reading frame encoding at least one DENV antigenic polypeptide and at least one ZIKV antigenic polypeptide, wherein at least 80% of the uracil in the open reading frame have a chemical modification. Some embodiments of the present disclosure provide a combination vaccine that includes at least one RNA polynucleotide having an open reading frame encoding at least one CHIKV antigenic polypeptide, at least one DENV antigenic polypeptide, and at least one ZIKV antigenic polypeptide, wherein at least 80% of the uracil in the open reading frame have a chemical modification. In some embodiments, 100% of the uracil in the open reading frame have a chemical modification. In some embodiments, the chemical modification is in the 5-position of the uracil. In some embodiments, the chemical modification is a N1-methyl pseudouridine.

In some embodiments of any of the combination RNA vaccines described herein, the RNA polynucleotide of the RNA vaccine is formulated in a lipid nanoparticle (LNP) carrier. In some embodiments, the lipid nanoparticle comprises a cationic lipid, a PEG-modified lipid, a sterol and a non-cationic lipid. In some embodiments, the lipid nanoparticle carrier comprising a molar ratio of about 20-60% cationic lipid: 5-25% non-cationic lipid: 25-55% sterol; and 0.5-15% PEG-modified lipid. In some embodiments, the cationic lipid is an ionizable cationic lipid. In some embodiments, the non-cationic lipid is a neutral lipid. In some embodiments, the sterol is a cholesterol. In some embodiments, the cationic lipid is selected from 2,2-dilinoleyl-4-dimethylaminoethyl[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319). In some embodiments, the lipid nanoparticle has a polydispersity value of less than 0.4. In some embodiments, the lipid nanoparticle has a net neutral charge at a neutral pH. In some embodiments, the lipid nanoparticle has a mean diameter of 50-200 nm.

Some embodiments of the present disclosure provide a vaccine that includes at least one RNA polynucleotide having an open reading frame encoding at least one CHIKV antigenic polypeptide, at least one 5' terminal cap and at least one chemical modification, formulated within a lipid nanoparticle. Some embodiments of the present disclosure provide a vaccine that includes at least one RNA polynucleotide having an open reading frame encoding at least one DENV antigenic polypeptide, at least one 5' terminal cap and at least one chemical modification, formulated within a lipid nanoparticle. Some embodiments of the present disclosure provide a vaccine that includes at least one RNA polynucleotide having an open reading frame encoding at least one ZIKV antigenic polypeptide, at least one 5' terminal cap and at least one chemical modification, formulated within a lipid nanoparticle.

Some embodiments of the present disclosure provide a combination vaccine that includes at least one RNA polynucleotide having an open reading frame encoding at least one CHIKV antigenic polypeptide and at least one DENV antigenic polypeptide, at least one 5' terminal cap and at least one chemical modification, formulated within a lipid nanoparticle. Some embodiments of the present disclosure provide a combination vaccine that includes at least one RNA polynucleotide having an open reading frame encoding at least one CHIKV antigenic polypeptide and at least one ZIKV antigenic polypeptide, at least one 5' terminal cap and at least one chemical modification, formulated within a lipid nanoparticle. Some embodiments of the present disclosure provide a combination vaccine that includes at least one RNA polynucleotide having an open reading frame encoding at least one ZIKV antigenic polypeptide and at least one DENV antigenic polypeptide, at least one 5' terminal cap and at least one chemical modification, formulated within a lipid nanoparticle. Some embodiments of the present disclosure provide a combination vaccine that includes at least one RNA polynucleotide having an open reading frame encoding at least one CHIKV antigenic polypeptide, at least one DENV antigenic polypeptide, at least one ZIKV antigenic polypeptide, at least one 5' terminal cap and at least one chemical modification, formulated within a lipid nanoparticle.

Some embodiments of the present disclosure provide a vaccine that includes at least one RNA polynucleotide having an open reading frame encoding at least one CHIKV antigenic polypeptide, wherein the open reading frame of the RNA polynucleotide is codon-optimized. Some embodiments of the present disclosure provide a vaccine that includes at least one RNA polynucleotide having an open reading frame encoding at least one DENV antigenic polypeptide, wherein the open reading frame of the RNA polynucleotide is codon-optimized. Some embodiments of the present disclosure provide a vaccine that includes at least one RNA polynucleotide having an open reading frame encoding at least one ZIKV antigenic polypeptide, wherein the open reading frame of the RNA polynucleotide is codon-optimized.

Some embodiments of the present disclosure provide a combination vaccine that includes at least one RNA polynucleotide having an open reading frame encoding at least one CHIKV antigenic polypeptide and at least one DENV antigenic polypeptide, wherein the open reading frame of the RNA polynucleotide is codon-optimized. Some embodiments of the present disclosure provide a combination vaccine that includes at least one RNA polynucleotide having an open reading frame encoding at least one CHIKV antigenic polypeptide and at least one ZIKV antigenic polypeptide, wherein the open reading frame of the RNA polynucleotide is codon-optimized. Some embodiments of the present disclosure provide a combination vaccine that includes at least one RNA polynucleotide having an open reading frame encoding at least one ZIKV antigenic polypeptide and at least one DENV antigenic polypeptide, wherein the open reading frame of the RNA polynucleotide is codon-optimized. Some embodiments of the present disclosure provide a combination vaccine that includes at least one RNA polynucleotide having an open reading frame encoding at least one CHIKV antigenic polypeptide, at least one DENV antigenic polypeptide, and at least one ZIKV antigenic polypeptide, wherein the open reading frame of the RNA polynucleotide is codon-optimized.

Some embodiments of the present disclosure provide methods of inducing an antigen specific immune response in a subject, comprising administering to the subject a combination RNA vaccine in an amount effective to produce an antigen specific immune response against CHIKV, against DENV, against ZIKV, against CHIKV and DENV, against CHIKV and ZIKV, against DENV and ZIKV, or against CHIKV, DENV and ZIKV. In some embodiments, an antigen specific immune response comprises a T cell response. In some embodiments, an antigen specific immune response comprises a B cell response. In some embodiments, an antigen specific immune response comprises both a T cell response and a B cell response. In some embodiments, a method of producing an antigen specific immune response involves a single administration of the vaccine. In other embodiments, the method further comprises administering to the subject a second dose or a booster dose of the vaccine. In other embodiments the method comprises administering more than one dose of the vaccine, for example, 2, 3, 4 or more doses of the vaccine. In some embodiments, the vaccine is administered to the subject by intradermal or intramuscular injection.

Further provided herein are vaccines, such as any of the vaccines described herein, for use in a method of inducing an antigen specific immune response in a subject, the method comprising administering the vaccine to the subject in an effective amount to produce an antigen specific immune response.

Further provided herein are uses of CHIKV, DENV or ZIKV RNA vaccines and CHIKV/DENV, CHIKV/ZIKV, DENV/ZIKV or CHIKV/DENV/ZIKV combination RNA vaccines in the manufacture of a medicament for use in a method of inducing an antigen specific immune response in a subject, the method comprising administering the vaccine to the subject in an amount effective to produce an antigen specific immune response.

In other aspects of the invention is a method of preventing or treating a CHIKV, DENV, ZIKV, CHIKV/DENV, CHIKV/ZIKV, DENV/ZIKV, or CHIKV/DENV/ZIKV infection comprising administering to a subject any of the vaccines described herein. In yet other aspects of the invention is a method of preventing or treating CHIKV, DENV, ZIKV, CHIKV/DENV, CHIKV/ZIKV, DENV/ZIKV, or CHIKV/DENV/ZIKV In some embodiments, a CHIKV, DENV, ZIKV, CHIKV/DENV, CHIKV/ZIKV, DENV/ZIKV, or CHIKV/DENV/ZIKV vaccine, is formulated in an effective amount to produce an antigen specific immune response in a subject.

In some embodiments, an anti-CHIKV, an anti-DENV, an anti-ZIKV, an anti-CHIKV/anti-DENV, an anti-CHIKV/anti-ZIKV, an anti-DENV/anti-ZIKV, or an anti-CHIKV/anti-DENV/anti-ZIKV antigenic polypeptide antibody titer produced in the subject is increased by at least 1 log relative to a control. In some embodiments, the anti-CHIKV, anti-DENV, anti-ZIKV, anti-CHIKV/anti-DENV, anti-CHIKV/anti-ZIKV, anti-DENV/anti-ZIKV, or an anti-CHIKV/anti-DENV/anti-ZIKV antigenic polypeptide antibody titer produced in the subject is increased by 1-3 log relative to a control. In some embodiments, the anti-CHIKV, anti-DENV, anti-ZIKV, anti-CHIKV/anti-DENV, anti-CHIKV/anti-ZIKV, anti-DENV/anti-ZIKV, or an anti-CHIKV/anti-DENV/anti-ZIKV antigenic polypeptide antibody titer produced in the subject is increased at least 2 times relative to a control. In some embodiments, the anti-CHIKV, anti-DENV, anti-ZIKV, anti-CHIKV/anti-DENV, anti-CHIKV/anti-ZIKV, anti-DENV/anti-ZIKV, or an anti-CHIKV/anti-DENV/anti-ZIKV antigenic polypeptide antibody titer produced in the subject is increased at least 5 times relative to a control. In some embodiments, the anti-CHIKV, anti-DENV, anti-ZIKV, anti-CHIKV/anti-DENV, anti-CHIKV/anti-ZIKV, anti-DENV/anti-ZIKV, or an anti-CHIKV/anti-DENV/anti-ZIKV antigenic polypeptide antibody titer produced in the subject is increased at least 10 times relative to a control. In some embodiments, the anti-CHIKV, anti-DENV, anti-ZIKV, anti-CHIKV/anti-DENV, anti-CHIKV/anti-ZIKV, anti-DENV/anti-ZIKV, or an anti-CHIKV/anti-DENV/anti-ZIKV antigenic polypeptide antibody titer produced in the subject is increased 2-10 times relative to a control.

In some embodiments, the control is an anti-CHIKV, anti-DENV, anti-ZIKV, anti-CHIKV/anti-DENV, anti-CHIKV/anti-ZIKV, anti-DENV/anti-ZIKV, or an anti-CHIKV/anti-DENV/anti-ZIKV antigenic polypeptide antibody titer produced in a subject who has not been administered a combination (or any other) vaccine. In some embodiments, the control is an anti-CHIKV, anti-DENV, anti-ZIKV, anti-CHIKV/anti-DENV, anti-CHIKV/anti-ZIKV, anti-DENV/anti-ZIKV, or an anti-CHIKV/anti-DENV/anti-ZIKV antigenic polypeptide antibody titer produced in a subject who has been administered a live attenuated or inactivated CHIKV, DENV, ZIKV, CHIKV/DENV, CHIKV/ZIKV, DENV/ZIKV, or CHIKV/DENV/ZIKV, vaccine. In some embodiments, the control is an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a subject who has been administered a recombinant or purified CHIKV, DENV, ZIKV, CHIKV/DENV, CHIKV/ZIKV, DENV/ZIKV, or CHIKV/DENV/ZIKV protein vaccine.

In some embodiments, the effective amount is a dose equivalent to an at least 2-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, the effective amount is a dose equivalent to an at least 4-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, the effective amount is a dose equivalent to an at least 10-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, the effective amount is a dose equivalent to an at least 100-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, the effective amount is a dose equivalent to an at least 1000-fold reduction in the standard of care dose of a recombinant CHIKV/DENV/ZIKV, or DENV/ZIKV, protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, the effective amount is a dose equivalent to a 2-1000-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, the effective amount is a total dose of 50-1000 μg. In some embodiments, the effective amount is a total dose of 100 μg. In some embodiments, the effective amount is a dose of 25 μg administered to the subject a total of two times. In some embodiments, the effective amount is a dose of 100 μg administered to the subject a total of two times. In some embodiments, the effective amount is a dose of 400 μg administered to the subject a total of two times. In some embodiments, the effective amount is a dose of 500 μg administered to the subject a total of two times.

Further provided herein is a method of inducing an antigen specific immune response in a subject, the method including administering to a subject the CHIKV, DENV, ZIKV, CHIKV/DENV, CHIKV/ZIKV, DENV/ZIKV, or CHIKV/DENV/ZIKV vaccine in an effective amount to produce an antigen specific immune response in a subject. In some embodiments, anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV, antigenic polypeptide antibody titer produced in the subject is increased by at least 1 log relative to a control. In some embodiments, an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV, antigenic polypeptide antibody titer produced in the subject is increased by 1-3 log relative to a control. In some embodiments, the anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV, antigenic polypeptide antibody titer produced in the subject is increased at least 2 times relative to a control. In some embodiments, the anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV, antigenic polypeptide antibody titer produced in the subject is increased at least 5 times relative to a control. In some embodiments, the anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is increased at least 10 times relative to a control. In some embodiments, the anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is increased 2-10 times relative to a control.

In some embodiments, the control is an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a subject who has not been administered CHIKV/DENV/ZIKV, or DENV/ZIKV, vaccine. In some embodiments, the control is an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a subject who has been administered a live attenuated or inactivated CHIKV, DENV, ZIKV, CHIKV/DENV, CHIKV/ZIKV, DENV/ZIKV, or CHIKV/DENV/ZIKV vaccine. In some embodiments, the control is an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a subject who has been administered a recombinant or purified CHIKV, DENV, ZIKV, CHIKV/DENV, CHIKV/ZIKV, DENV/ZIKV, or CHIKV/DENV/ZIKV protein vaccine.

In some embodiments, the effective amount is a dose equivalent to an at least 2-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant CHIKV, DENV, ZIKV, CHIKV/DENV, CHIKV/ZIKV, DENV/ZIKV, or CHIKV/DENV/ZIKV protein vaccine or a live attenuated CHIKV, DENV, ZIKV, CHIKV/DENV, CHIKV/ZIKV, DENV/ZIKV, or CHIKV/DENV/ZIKV vaccine.

In some embodiments, the effective amount is a dose equivalent to an at least 4-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, the effective amount is a dose equivalent to an at least 10-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHI KV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, the effective amount is a dose equivalent to an at least 100-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, the effective amount is a dose equivalent to an at least 1000-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, wherein the effective amount is a dose equivalent to a 2-1000-fold reduction in the standard of care dose of a recombinant CHIKV, DENV, ZIKV, CHIKV/DENV, CHIKV/ZIKV, DENV/ZIKV, or CHIKV/DENV/ZIKV protein vaccine, and wherein an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in the subject is equivalent to an anti-CHIKV, anti-DENV, anti-ZIKV, anti-CHIKV/anti-DENV, anti-CHIKV/anti-ZIKV, anti-DENV/anti-ZIKV, or anti-CHIKV/anti-DENV/anti-ZIKV antigenic polypeptide antibody titer produced in a control subject administered the standard of care dose of a recombinant or purified CHIKV, DENV, ZIKV, CHIKV/DENV, CHIKV/ZIKV, DENV/ZIKV, or CHIKV/DENV/ZIKV, protein vaccine or a live attenuated or inactivated CHIKV, DENV, ZIKV, CHIKV/DENV, CHIKV/ZIKV, DENV/ZIKV, or CHIKV/DENV/ZIKV vaccine.

In some embodiments, the effective amount is a total dose of 50-1000 μg. In some embodiments, the effective amount is a total dose of 100 μg. In some embodiments, the effective amount is a dose of 25 μg administered to the subject a total of two times. In some embodiments, the effective amount is a dose of 100 μg administered to the subject a total of two times. In some embodiments, the effective amount is a dose of 400 μg administered to the subject a total of two times. In some embodiments, the effective amount is a dose of 500 μg administered to the subject a total of two times.

Other aspects of the present disclosure provide a CHIKV, DENV, ZIKV, CHIKV/DENV, CHIKV/ZIKV, DENV/ZIKV, or CHIKV/DENV/ZIKV vaccine, which includes a signal peptide linked to a CHIKV, DENV, ZIKV, CHIKV/DENV, CHIKV/ZIKV, DENV/ZIKV, or CHIKV/DENV/ZIKV protein. In some embodiments, the signal peptide is a IgE signal peptide. In some embodiments, the signal peptide is an IgE HC (Ig heavy chain epsilon-1) signal peptide.

Further provided herein, is a nucleic acid encoding CHIKV, DENV, ZIKV, CHIKV/DENV, CHIKV/ZIKV, DENV/ZIKV, or CHIKV/DENV/ZIKV vaccine.

Another aspect of the present disclosure provides a CHIKV, DENV, ZIKV, CHIKV/DENV, CHIKV/ZIKV, DENV/ZIKV, or CHIKV/DENV/ZIKV vaccine, which includes at least one ribonucleic acid (RNA) polynucleotide having an open reading frame encoding a signal peptide linked to a CHIKV, DENV, and/or ZIKV antigenic peptide. In some embodiments, the CHIKV, DENV, and/or ZIKV antigenic peptide is a CHIKV, DENV, and/or ZIKV envelope protein.

In some embodiments, the signal peptide is a IgE signal peptide. In some embodiments, the signal peptide is an IgE HC (Ig heavy chain epsilon-1) signal peptide. In some embodiments, the signal peptide has the sequence MDWTWILFLVAAATRVHS (SEQ ID NO: 126). In some embodiments, the signal peptide is an IgGκ signal peptide. In some embodiments, the signal peptide has the sequence METPAQLLFLLLLWLPDTTG (SEQ ID NO: 125).

In any of the aspects and embodiments described herein the combination vaccine is a CHIKV/DENV/ZIKV, CHIKV/DENV, CHIKV/ZIKV, and/or DENV/ZIKV vaccine.

Each of the limitations of the invention can encompass various embodiments of the invention. It is, therefore, anticipated that each of the limitations of the invention involving any one element or combinations of elements can be included in each aspect of the invention. This invention is not limited in its application to the details of construction and the arrangement of components set forth in the following description or illustrated in the drawings. The invention is capable of other embodiments and of being practiced or of being carried out in various ways.

BRIEF DESCRIPTION OF DRAWINGS

The accompanying drawings are not intended to be drawn to scale. In the drawings, each identical or nearly identical component that is illustrated in various figures is represented by a like numeral. For purposes of clarity, not every component may be labeled in every drawing. In the drawings:

FIG. 7 shows the study design, schedule of injection/bleeding, readout, and survival data for the 2 μg dose study of the CHIKV E1, CHIKV E2, and CHIKV E1/E2/E3/6K/C vaccines.

FIG. 11 shows the study design, schedule of injection/bleeding, readout, and survival data for the 10 μg dose study of the CHIKV E1, CHIKV E2, and CHIKV C-E3-E2-6K-E1 vaccines.

FIGS. 17A-17C show Dengue Virus MHC II T cell epitopes.

FIG. 20 is a schematic of a bone marrow/liver/thymus (BLT) mouse and data on human CD8 T cells stimulated with Dengue peptide epitope.

FIG. 35 shows an in vitro antigen presentation assays using OVA (peptide epitope of ovalbumin) multitopes to test different DENV mRNA vaccine construct configurations.

FIG. 38A shows the immunization, challenge, and serum collection schedules. FIG. 38B shows the survival of the AG129 mice challenged with Dengue D2Y98P virus after being immunized with the indicated DENV mRNA vaccines. All immunized mice survived 11 days post infection, while the unimmunized (control) mice died. FIGS. 38C and 38D show the weight loss of the AG129 mice post infection. Vaccine 1, 7, 8, or 9 correspond to DENV vaccine construct 22, 21, 23, or 24 of the present disclosure, respectively.

FIGS. 40A-40F show the survival, weight loss, and heath score of the AG129 mice challenged with D2Y98P virus after being immunized with the DENV mRNA vaccine groups 1-12 in Table 40. FIGS. 40G-40I show the survival, weight loss, and heath score of the AG129 mice challenged with D2Y98P virus after being immunized with the DENV mRNA vaccine groups 13-19 in Table 40.

FIG. 42A shows the survival curve of mice groups 1-4 and 7-9 challenged on day 56 post immunization. FIG. 42B shows the survival curve of mice groups 10-16 challenged on day 112 post immunization. Survival curves were plotted as "percent survival" versus "days post infection." See also Table 45 for survival percentage.

FIG. 43A shows the weight change of mice groups 1-4 and 7-9 challenged on day 56 post immunization. FIG. 43B shows the weight changes of mice groups 10-16 challenged on day 112 post immunization. Initial weights were assessed on individual mice on study Day 0 and daily thereafter. The mean percent weights for each group compared to their percent weight on Day 0 (baseline) were plotted against "days post-infection". Error bars represent the standard deviation (SD).

FIG. 44A shows the health scores of mice groups 1-4 and 7-9 challenged on day 56 post immunization. FIG. 44B shows the health score of mice groups 10-16 challenged on day 112 post immunization. The mean health scores for each group were plotted against "days post infection" and error bars represent the SD. Mean health scores were calculated based on observations described in Table 5.

FIG. 45A shows the serum antibody titers against CHIKV E1 protein. FIG. 45B shows the serum antibody titers against CHIKV E2 protein. FIG. 45C shows the serum antibody titers against CHIKV lysate.

FIG. 45A shows the serum antibody titers against CHIKV E1 protein. FIG. 46B shows the serum antibody titers against CHIKV E2 protein. FIG. 46C shows the serum antibody titers against CHIKV lysate.

FIG. 47A shows the serum antibody titers against CHIKV E1 protein. FIG. 47B shows the serum antibody titers against CHIKV E2 protein. FIG. 47C shows the serum antibody titers against CHIKV lysate.

FIG. 48A shows the serum antibody titers against CHIKV E1 protein. FIG. 48B shows the serum antibody titers against CHIKV E2 protein. FIG. 48C shows the serum antibody titers against CHIKV lysate.

FIG. 50 shows a set of graphs depicting results of an ELISA assay to identify the amount of antibodies produced in AG129 mice in response to vaccination with mRNA encoding secreted CHIKV E1 structural protein, secreted CHIKV E2 structural protein, or CHIKV full structural polyprotein C-E3-E2-6k-E1 at a dose of 10 μg or 2 μg at 28 days post immunization.

DETAILED DESCRIPTION

Embodiments of the present disclosure provide RNA (e.g., mRNA) vaccines that are useful for vaccinating against one or multiple viruses. The vaccines, including combination vaccines, of the invention encode antigens from chikungunya virus (CHIKV), Zika virus (ZIKV), Dengue virus (DENV), or any combination of two or three of the foregoing viruses. A balanced immune response, comprising both cellular and humoral immunity, can be generated against CHIKV, against DENV, against ZIKV, against CHIKV and DENV, against CHIKV and ZIKV, against DENV and ZIKV, or against CHIKV, DENV and ZIKV, using the constructs of the invention without many of the risks associated with DNA vaccines and live attenuated vaccines. The various RNA vaccines disclosed herein produced surprising efficacy in animal models of Chikungunya infection, and Dengue infection, the results of which are discussed in detail in the Examples section. Specifically, RNA polynucleotide vaccines having an open reading frame encoding for a variety of Chikungunya antigens produced significant immunity, whereas traditional Chikungunya vaccines have not (e.g. attenuated chikungunya viruses). The CHIKV RNA polynucleotide vaccines disclosed herein encoding either CHIKV-E1, CHIKV-E2 or CHIK-C-E3-E2-6K-E1 demonstrated a survival rate of 60%-100% after two administrations. Specifically, two injections of CHIKV E1 mRNA vaccine provided nearly full protection against infection when administered intramuscularly (IM) (60% survival) or intradermally (ID) (80% survival). Two injections of CHIKV E2 mRNA vaccine or CHIKV C-E3-E2-6K-E1 vaccine provided full protection (100% survival) against infection when administered via IM or ID. Importantly, a single injection (no booster dose) of CHIKV C-E3-E2-6K-E1 vaccine provided full protection (100% survival) against infection when administered via IM or ID.

DENV RNA vaccines and ZIKV vaccines are also disclosed herein as well as combination DENV and CHIKV, CHIKV and ZIKV, and DENV and ZIKV vaccines. The combination vaccines of CHIKV, DENV and ZIKV, DENV and ZIKV, CHIKV and ZIKV, or CHIKV and DENV can provide a means for protecting against two or more viral infections in a single vaccine.

Figure 1A:
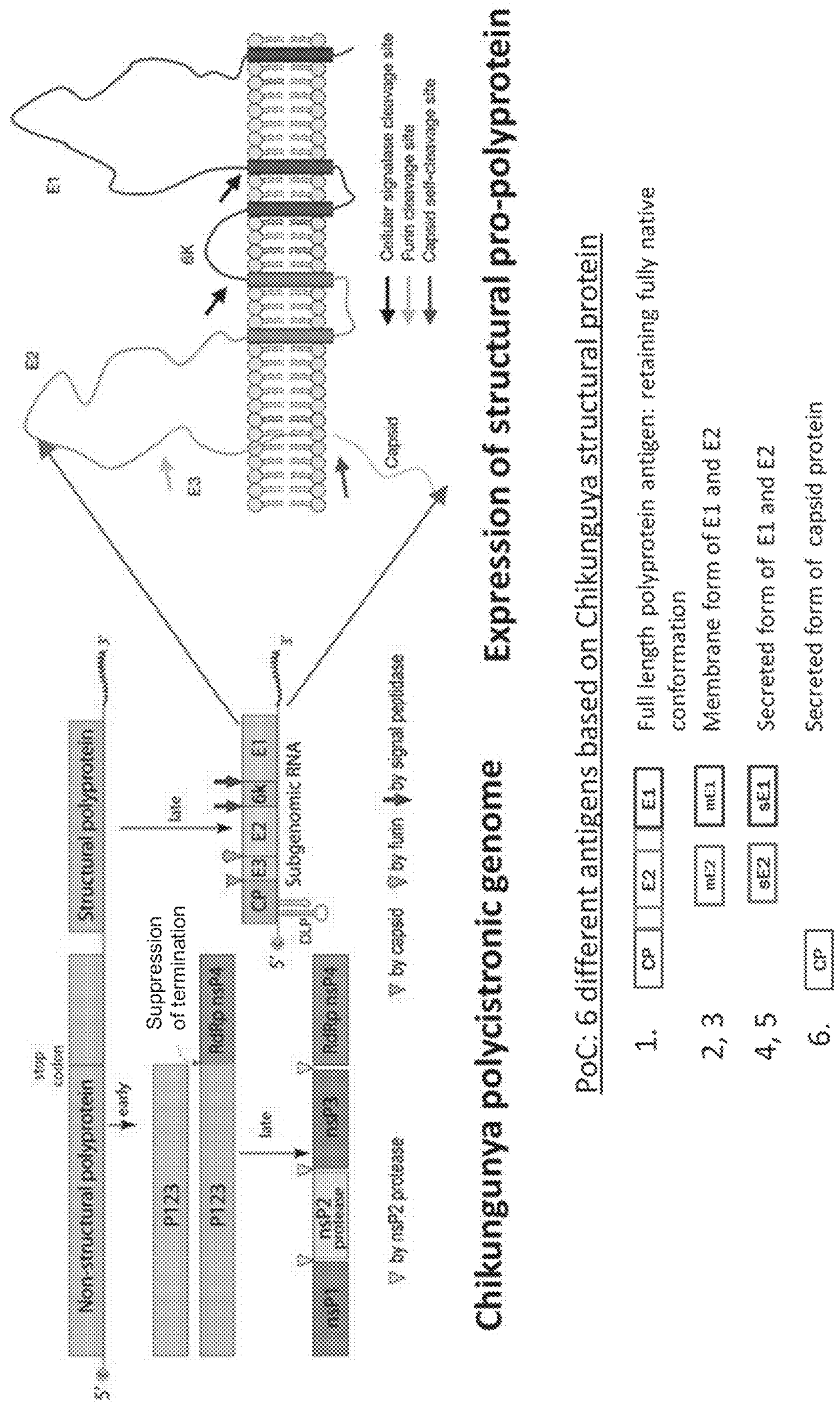
FIG. 1A shows a schematic depiction of the post-translational process of CHIKV structural proteins.
Figure 1B:
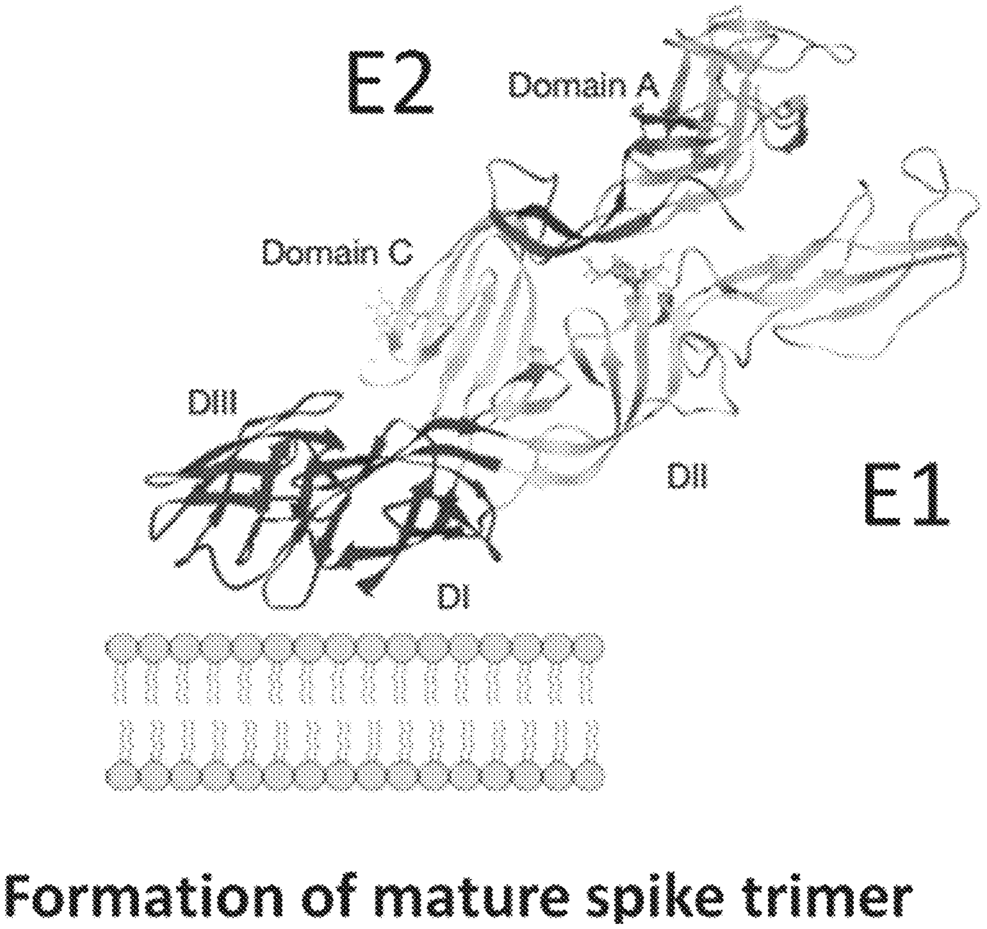
FIG. 1B shows a schematic depiction of the E1/E2 heterodimer that associates as a trimeric spike on the CHIKV viral surface.

Chikungunya virus is a small (about 60-70 nm-diameter), spherical, enveloped, positive-strand RNA virus having a capsid with icosahedral symmetry. The virion consists of an envelope and a nucleocapsid. The virion RNA is infectious and serves as both genome and viral messenger RNA. The genome is a linear, ssRNA(+) genome of 11,805 nucleotides which encodes for two polyproteins that are processed by host and viral proteases into non-structural proteins (nsP1, nsP2, nsP3, and RdRpnsP4) necessary for RNA synthesis (replication and transcription) and structural proteins (capsid and envelope proteins C, E3, E2, 6K, and E1) which attach to host receptors and mediate endocytosis of virus into the host cell. (FIG. 1). The E1 and E2 glycoproteins form heterodimers that associate as 80 trimeric spikes on the viral surface covering the surface evenly. The envelope glycoproteins play a role in attachment to cells. The capsid protein possesses a protease activity that results in its self-cleavage from the nascent structural protein. Following its cleavage, the capsid protein binds to viral RNA and rapidly assembles into icosahedric core particles. The resulting nucleocapsid eventually associates with the cytoplasmic domain of E2 at the cell membrane, leading to budding and formation of mature virions.

E2 is an envelope glycoprotein responsible for viral attachment to target host cell, by binding to the cell receptor. E2 is synthesized as a p62 precursor which is processed at the cell membrane prior to virion budding, giving rise to an E2-E1 heterodimer. The C-terminus of E2 is involved in budding by interacting with capsid proteins.

E1 is an envelope glycoprotein with fusion activity, which fusion activity is inactive as long as E1 is bound to E2 in the mature virion. Following virus attachment to target cell and endocytosis, acidification of the endosome induces dissociation of the E1/E2 heterodimer and concomitant trimerization of the E1 subunits. The E1 trimer is fusion active and promotes the release of the viral nucleocapsid in the cytoplasm after endosome and viral membrane fusion.

E3 is an accessory protein that functions as a membrane translocation/transport signal for E1 and E2.

6K is another accessory protein involved in virus glycoprotein processing, cell permeabilization, and the budding of viral particles Like E3, it functions as a membrane transport signal for E1 and E2.

The CHIKV structural proteins have been shown to be antigenic, which proteins, fragments, and epitopes thereof are encompassed within the invention. A phylogenetic tree of Chikungunya virus strains derived from complete concatenated open reading frames for the nonstructural and structural polyproteins shows key envelope glycoprotein E1 amino acid substitutions that facilitated (Indian Ocean lineage) or prevented (Asian lineage) adaptation to *Aedes albopictus*. There are membrane-bound and secreted forms of E1 and E2, as well as the full length polyprotein antigen (C-E3-E2-6K-E1), which retains the protein's native conformation. Additionally, the different Chikungunya genotypes, strains and isolates can also yield different antigens, which are functional in the constructs of the invention. For example, there are several different Chikungunya genotypes: Indian Ocean, East/Central/South African (ECSA), Asian, West African, and the Brazilian isolates (ECSA/Asian). There are three main Chikungunya genotype. These are ESCA (East-South-Central Africa); Asia; and West Africa. While sometimes names differ in publications all belong to these three geographical strains.

Dengue virus is a mosquito-borne (*Aedes aegypti/Aedes albopictus*) member of the family Flaviviridae (positive-sense, single-stranded RNA virus). The dengue virus genome encodes ten genes and is translated as a single polypeptide which is cut into ten proteins: the capsid, envelope, membrane, and nonstructural proteins (NS1, NS2A, NS2B, NS3, SN4A, NS4B, and NS5 proteins). The virus' main antigen is DENe, which is a component of the viral surface and is thought to facilitate the binding of the virus to cellular receptors (Heinz et al., *Virology.* 1983, 126:525). There are four similar but distinct serotypes of dengue virus (DEN-1, DEN-2, DEN-3, and DEN-4), which result annually in an estimated 50-100 million cases of dengue fever and 500,000 cases of the more severe dengue hemorrhagic fever/dengue shock syndrome (DHF/DSS) (Gubler et al., *Adv Virus Res.* 1999, 53:35-70). The four serotypes show immunological cross-reactivity, but are distinguishable in plaque reduction neutralization tests and by their respective monoclonal antibodies. The dengue virus E protein includes a serotype-specific antigenic determinant and determinants necessary for virus neutralization (Mason et al., *J Gen Virol.* 1990, 71:2107-2114).

After inoculation, the dendritic cells become infected and travel to lymph nodes. Monocytes and macrophages are also targeted shortly thereafter. Generally, the infected individual will be protected against homotypic reinfection for life; however, the individual will only be protected against other serotypes for a few weeks or months (Sabin, *Am J Trop Med Hyg.* 1952, 1:30-50). In fact, DHF/DSS is generally found in children and adults infected with a dengue virus serotype differing from their respective primary infection. Thus, it is necessary to develop a vaccine that provides immunity to all four serotypes.

Along with other viruses in the Flaviviridae family, Zika virus is enveloped and icosahedral with a non-segmented, single-stranded, positive sense RNA genome. It is most closely related to the Spondweni virus and is one of the two viruses in the Spondweni virus Glade. The virus was first isolated in 1947 from a rhesus monkey in the Zika Forest of Uganda, Africa and was isolated for the first time from humans in 1968 in Nigeria. From 1951 through 1981, evidence of human infection was reported from other African countries such as Uganda, Tanzania, Egypt, Central African Republic, Sierra Leone and Gabon, as well as in parts of Asia including India, Malaysia, the Philippines, Thailand, Vietnam and Indonesia. It is transmitted by mosquitoes and has been isolated from a number of species in the genus *Aedes—Aedes aegypti, Aedes africanus, Aedes apicoargenteus, Aedes furcifer, Aedes luteocephalus* and *Aedes vitattus*. Studies show that the extrinsic incubation period in mosquitoes is about 10 days. The vertebrate hosts of the virus include monkeys and humans.

As of early 2016, the most widespread outbreak of Zika fever, caused by the Zika virus, is ongoing primarily in the Americas. The outbreak began in April 2015 in Brazil, and subsequently spread to other countries in South America, Central America, and the Caribbean.

The Zika virus was first linked with newborn microcephaly during the Brazil Zika virus outbreak. In 2015, there were 2,782 cases of microcephaly compared with 147 in 2014 and 167 in 2013. The Brazilian Health Ministry has reported 4783 cases of suspected microcephaly as of January 30, an increase of more than 1000 cases from a week earlier. Confirmation of many of the recent cases is pending, and it is difficult to estimate how many cases went unreported before the recent awareness of the risk of virus infections.

What is important is not only the number of cases but also the clinical manifestation of the cases. Brazil is seeing severe cases of microcephaly, which are more likely to be paired with greater developmental delays. Most of what is being reported out of Brazil is microcephaly with other associated abnormalities. The potential consequence of this is the fact that there are likely to be subclinical cases where the neurological sequelae will only become evident as the children grow.

Zika virus has also been associated with an increase in a rare condition known as Guillain-Barré, where the infected individual becomes essentially paralyzed. During the Zika virus outbreak in French Polynesia, 74 patients which had had Zika symptoms—out of them, 42 were diagnosed as Guillain-Barré syndrome. In Brazil, 121 cases of neurological manifestations and Guillain-Barré syndrome (GBS) were reported, all cases with a history of Zika-like symptoms.

In some embodiments, ZIKV vaccines comprise RNA (e.g., mRNA) encoding a ZIKV antigenic polypeptide having at least 95%, at least 96%, at least 97%, at least 98% or at least 99% identity with ZIKV polyprotein and having ZIKV polyprotein activity, respectively. The ZIKV polyprotein is cleaved into capsid, precursor membrane, envelope, and non-structural proteins (NS1, NS2A, NS2B, NS3, NS4A, NS4B, NS5).

A protein is considered to have ZIKV polyprotein activity if, for example, it facilitates the attachment of the viral envelope to host receptors, mediates internalization into the host cell, and aids in fusion of the virus membrane with the host's endosomal membrane.

The RNA vaccines may be utilized in various settings depending on the prevalence of the infection or the degree or level of unmet medical need. The RNA vaccines may be utilized to treat and/or prevent a CHIKV, DENV and/or ZIKV infection of various genotypes, strains, and isolates. The RNA vaccines have superior properties in that they produce much larger antibody titers and produce responses early than commercially available anti-viral therapeutic treatments. While not wishing to be bound by theory, it is believed that the RNA vaccines, as mRNA polynucleotides, are better designed to produce the appropriate protein conformation upon translation as the RNA vaccines co-opt natural cellular machinery. Unlike traditional vaccines which are manufactured ex vivo and may trigger unwanted cellular responses, the RNA vaccines are presented to the cellular system in a more native fashion.

The entire contents of International Application No. PCT/US2015/02740 is incorporated herein by reference.

Nucleic Acids/Polynucleotides

Vaccines, including combination vaccines, as provided herein, comprise at least one (one or more) ribonucleic acid (RNA) polynucleotide having an open reading frame encoding at least one CHIKV antigenic polypeptide, at least one ZIKV antigenic polypeptide, at least one DENV antigenic polypeptide, at least one CHIKV antigenic polypeptide and at least one DENV antigenic polypeptide, at least one CHIKV antigenic polypeptide and at least one ZIKV antigenic polypeptide, at least one ZIKV antigenic polypeptide and at least one DENV antigenic polypeptide, or at least one CHIKV antigenic polypeptide, at least one DENV antigenic polypeptide and at least one ZIKV antigenic polypeptide. In some embodiments, the vaccine, including combination vaccines, comprise at least one RNA polynucleotide, e.g., mRNA, having an open reading frame encoding two or more different CHIKV antigenic polypeptides, ZIKV antigenic polypeptides, and/or DENV antigenic polypeptides (e.g., two, three, four, five or more different antigenic polypeptides). In some embodiments, the combination vaccine comprises at least one RNA polynucleotide having an open reading frame encoding a CHIKV antigenic polypeptide or epitope, a ZIKV antigenic polypeptide or epitope, a DENV antigenic polypeptide or epitope, or a combination of any two or three of the forgoing. The term "nucleic acid," in its broadest sense, includes any compound and/or substance that comprises a polymer of nucleotides. These polymers are referred to as polynucleotides. As used herein the term polypeptide refers to full-length proteins, protein fragments, variants, and epitopes.

In some embodiments, an RNA polynucleotide, e.g., mRNA, of a combination vaccine encodes at least 2, 3, 4, 5, 6, 7, 8, 9 or 10 antigenic polypeptides. In some embodiments, an RNA polynucleotide comprises 30 to 12,000 or more nucleotides. For example, a polynucleotide may include 30 to 100, 101 to 200, 200 to 500, 200 to 1000, 200 to 1500, 200 to 2000, 200 to 3000, 500 to 1000, 500 to 1500, 500 to 2000, 500 to 3000, 1000 to 1500, 1000 to 2000, 1000 to 3000, 1500 to 3000, 1500 to 4000, 1500 to 5000, 2000 to 3000, 2000 to 4000, 2000 to 5000, 5000 to 7500, 7500 to 10,000, or 10,000 to 12,000 nucleotides.

In some embodiments, the combination vaccine comprises at least one RNA polynucleotide having an open reading frame encoding a Chikungunya structural protein or an antigenic fragment or an antigenic epitope thereof. In some embodiments, the RNA polynucleotide has an open reading frame encoding a Chikungunya envelope and/or capsid antigenic polypeptide selected from a CHIKV E1, E2, E3, 6K, and capsid (C) antigenic polypeptide. In some embodiments, the RNA polynucleotide has an open reading frame encoding any combination of CHIKV E1, E2, E3, 6K, and capsid (C) antigenic polypeptides, for example, a combination selected from CHIKV E1 and E2 antigens, CHIKV E1 and E3 antigens, CHIKV E2 and E3 antigens, CHIKV E1, E2, and E3 antigens, CHIKV E1, E2, E3, and C antigens, CHIKV E1, E2, and 6K antigens, CHIKV E2, E3 and 6K antigens, CHIKV E1, E3, and 6K antigens, and CHIKV E1, E2, E3, 6K, and C antigens.

Some embodiments of the present disclosure provide DENV vaccines that include at least one ribonucleic acid (RNA) polynucleotide having an open reading frame encoding at least one DENV antigenic polypeptide or an immunogenic fragment or epitope thereof. Some embodiments of the present disclosure provide DENV vaccines that include at least one RNA polynucleotide having an open reading frame encoding two or more DENV antigenic polypeptides or an immunogenic fragment or epitope thereof. Some embodiments of the present disclosure provide DENV vaccines that include two or more RNA polynucleotides having an open reading frame encoding two or more DENV antigenic polypeptides or immunogenic fragments or epitopes thereof. The one or more DENV antigenic polypeptides may be encoded on a single RNA polynucleotide or may be encoded individually on multiple (e.g., two or more) RNA polynucleotides.

In some embodiments, the at least one RNA polynucleotide may encode at least one DENV antigenic polypeptide. In some instances the dengue viral antigenic polypeptide is an intact dengue virus peptide or other large antigen (i.e. greater than 25 amino acids in length). In some embodiments, the at least one RNA polynucleotide encodes a DENV capsid protein or immunogenic fragment or epitope thereof. In some embodiments, the at least one RNA polynucleotide encodes a DENV envelope protein or immunogenic fragment or epitope thereof. In some embodiments, the at least one RNA polynucleotide encodes a DENV membrane protein or immunogenic fragment or epitope thereof. In some embodiments, the at least one RNA polynucleotide encodes a DENV nonstructural protein or immunogenic fragment or epitope thereof. Large gene segments in non-structural genes, in particular may be used for antigens. In some embodiments, the DENV non-structural protein is selected from NS1, NS2A, NS2B, NS3, SN4A, NS4B, and NS5 proteins, or immunogenic fragments or epitopes thereof. In some embodiments, the DENV non-structural protein is NS3. In some embodiments, the at least one RNA polynucleotide encodes DENe, which is a component of the viral surface and is thought to facilitate the binding of the virus to cellular receptors. In any of these embodiments, the at least one RNA polynucleotide encodes a DENV polypeptide from a DENV serotype selected from DENV-1, DENV-2, DENV-3, and DENV-4. For example, the DENV polypeptide may be one or more polypeptides encoded by SEQ ID NO: 15 (DENV1), SEQ ID NO: 17 (DENV2), SEQ ID NO: 19 (DENV3), and SEQ ID NO: 21 (DENV4), In some embodiments, the DENV polypeptide is a polypeptide found in SEQ ID NO: 14 (DENV1), SEQ ID NO: 16 (DENV2), SEQ ID NO: 18 DENV3), and/or SEQ ID NO: 20 (DENV4). In some embodiments, the Dengue virus (DENV) vaccine comprises at least one (one or more) ribonucleic acid (RNA) polynucleotide having an open reading frame encoding SEQ ID NO: 23 or an immunogenic fragment or epitope thereof. In some embodiments, the Dengue virus (DENV) vaccine comprises at least one (one or more) ribonucleic acid (RNA) polynucleotide having an open reading frame encoding SEQ ID NO: 26 or an immunogenic fragment or epitope thereof. In some embodiments, the Dengue virus (DENV) vaccine comprises at least one (one or more) ribonucleic acid (RNA) polynucleotide having an open reading frame encoding SEQ ID NO: 29 or an immunogenic fragment or epitope thereof. In some embodiments, the Dengue virus (DENV) vaccine comprises at least one (one or more) ribonucleic acid (RNA) polynucleotide having an open reading frame encoding SEQ ID NO: 32 or an immunogenic fragment or epitope thereof. In some embodiments, the DENV RNA polynucleotide comprises SEQ ID NO: 25 (or is encoded by SEQ ID NO: 24) or a fragment thereof. In some embodiments, the DENV RNA polynucleotide comprises SEQ ID NO: 28 (or is encoded by SEQ ID NO: 27) or a fragment thereof. In some embodiments, the DENV RNA polynucleotide comprises SEQ ID NO: 31 (or is encoded by SEQ ID NO: 30) or a fragment thereof. In some embodiments, the DENV RNA polynucleotide comprises SEQ ID NO: 34 (or is encoded by SEQ ID NO: 33) or a fragment thereof. In some embodiments, the DENV RNA polynucleotide encodes a polypeptide comprising SEQ ID NO:23 or an immunogenic fragment or epitope thereof. In some embodiments, the DENV RNA polynucleotide encodes a polypeptide comprising SEQ ID NO: 26 or an immunogenic fragment or epitope thereof. In some embodiments, the DENV RNA polynucleotide encodes a polypeptide comprising SEQ ID NO: 29 or an immunogenic fragment or epitope thereof. In some embodiments, the DENV RNA polynucleotide encodes a polypeptide comprising SEQ ID NO: 32 or an immunogenic fragment or epitope thereof.

Dengue virus (DENV) vaccine antigens, as provided herein, comprise at least one (one or more) ribonucleic acid (RNA) polynucleotide having an open reading frame encoding at least one DENV antigenic polypeptide. In some embodiments, the DENV antigenic polypeptide is longer than 25 amino acids and shorter than 50 amino acids. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. Polypeptides may also comprise single chain or multichain polypeptides such as antibodies or insulin and may be associated or linked. Most commonly, disulfide linkages are found in multichain polypeptides. The term polypeptide may also apply to amino acid polymers in which at least one amino acid residue is an artificial chemical analogue of a corresponding naturally-occurring amino acid.

In other embodiments the antigen is a concatemeric peptide antigen composed of multiple peptide epitopes. In some embodiments, a RNA polynucleotide of a DENV vaccine encodes 2-10, 2-9, 2-8, 2-7, 2-6, 2-5, 2-4, 2-3, 3-10, 3-9, 3-8, 3-7, 3-6, 3-5, 3-4, 4-10, 4-9, 4-8, 4-7, 4-6, 4-5, 5-10, 5-9, 5-8, 5-7, 5-6, 6-10, 6-9, 6-8, 6-7, 7-10, 7-9, 7-8, 8-10, 8-9 or 9-10 antigenic polypeptides. In some embodiments, a RNA polynucleotide of a DENV vaccine encodes at least 10, 20, 30, 40, 50, 60, 70, 80, 90 or 100 antigenic polypeptides. In some embodiments, a RNA polynucleotide of a DENV vaccine encodes at least 100 or at least 200 antigenic polypeptides. In some embodiments, a RNA polynucleotide of a DENV vaccine encodes 1-10, 5-15, 10-20, 15-25, 20-30, 25-35, 30-40, 35-45, 40-50, 1-50, 1-100, 2-50 or 2-100 antigenic polypeptides.

Figure 15:
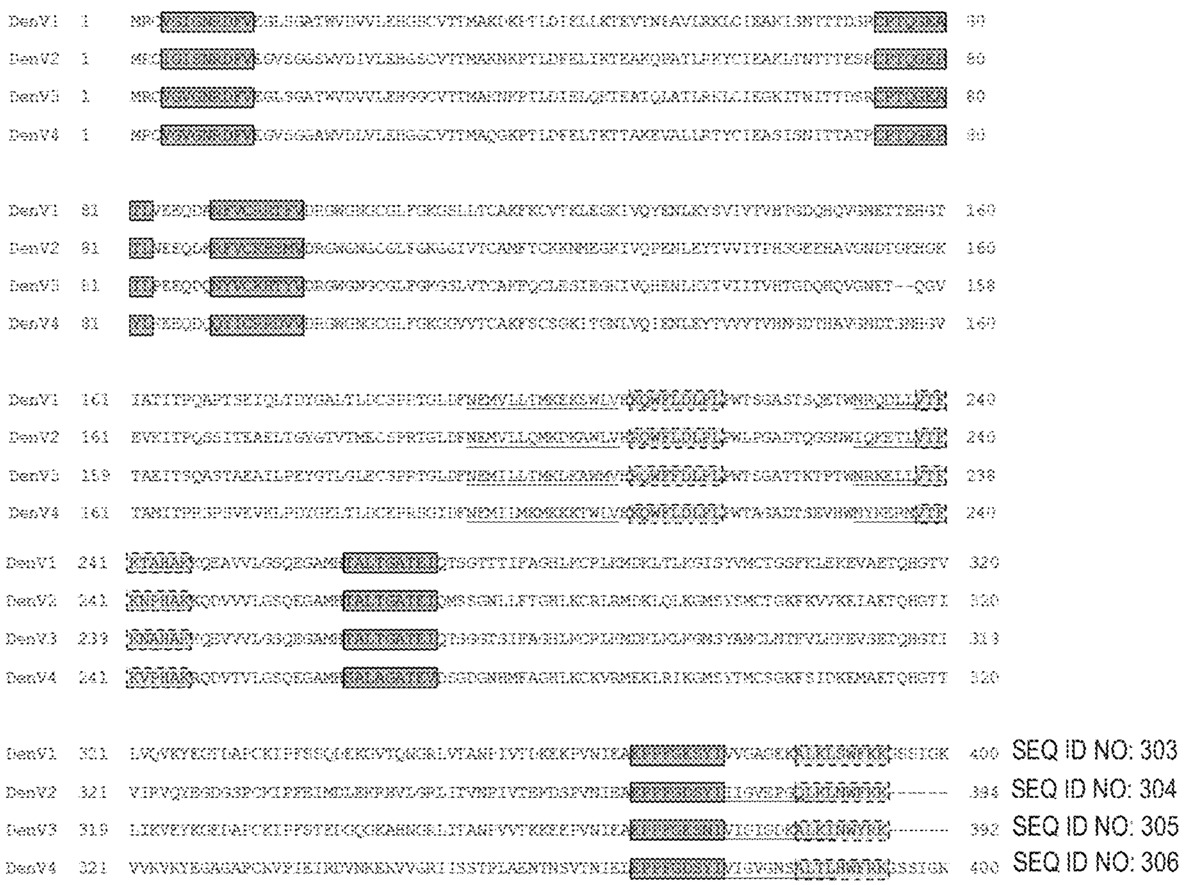
FIG. 15 shows exemplary dengue peptide epitopes identified using a database screen.
Figure 16A:
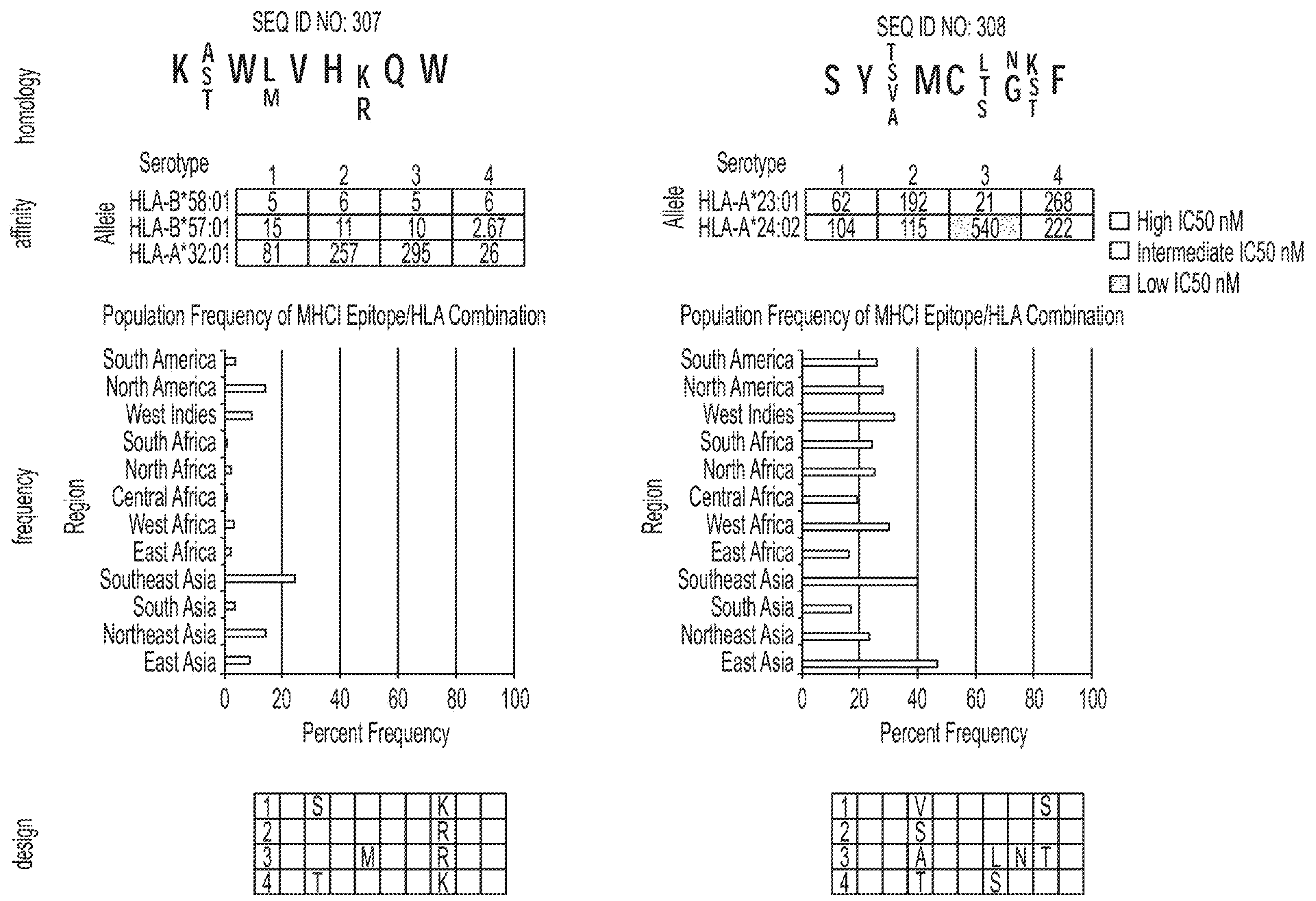
FIGS. 16A-16C show Dengue Virus MHC I T cell epitopes.
Figure 16B:
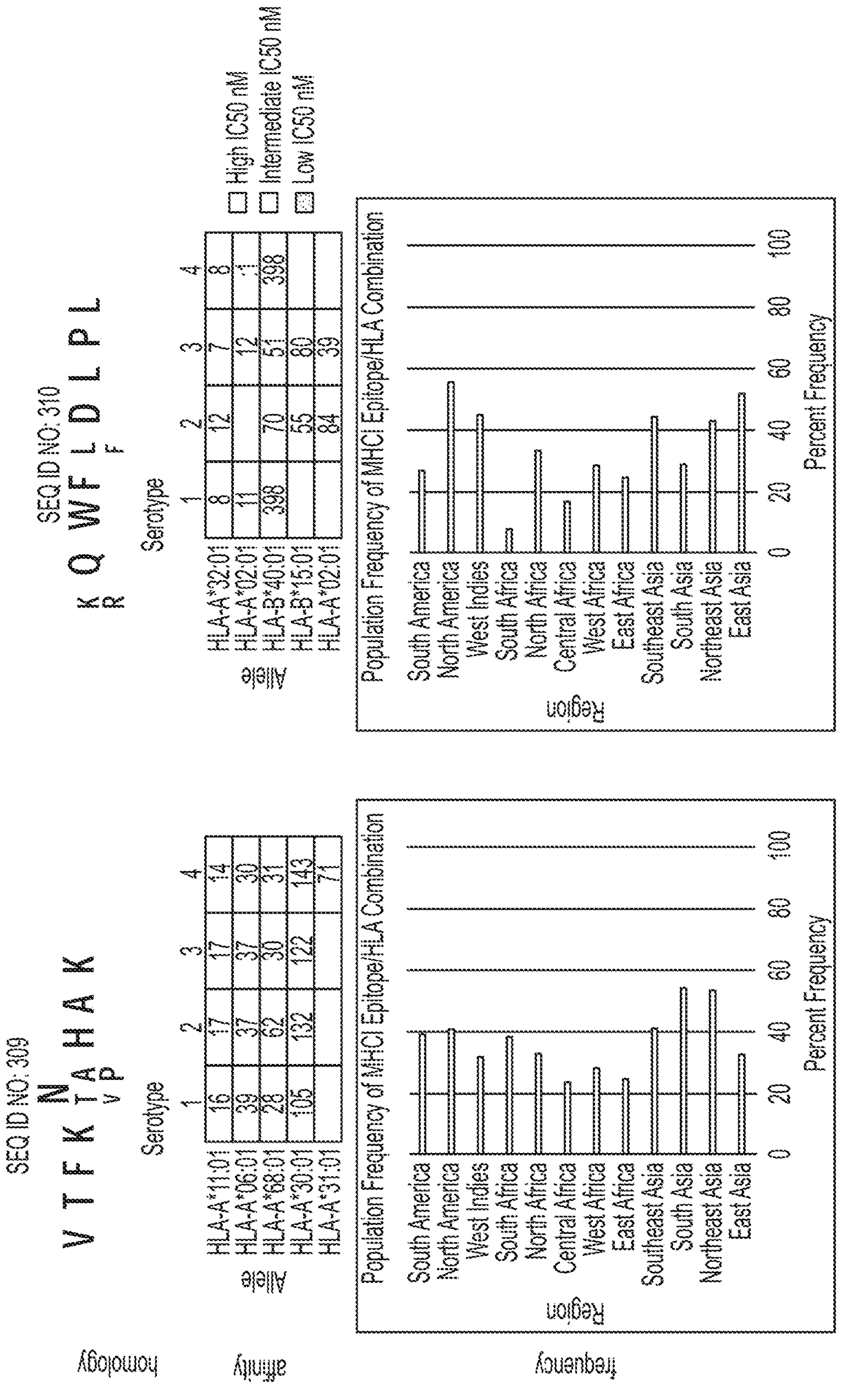
Figure 16C:
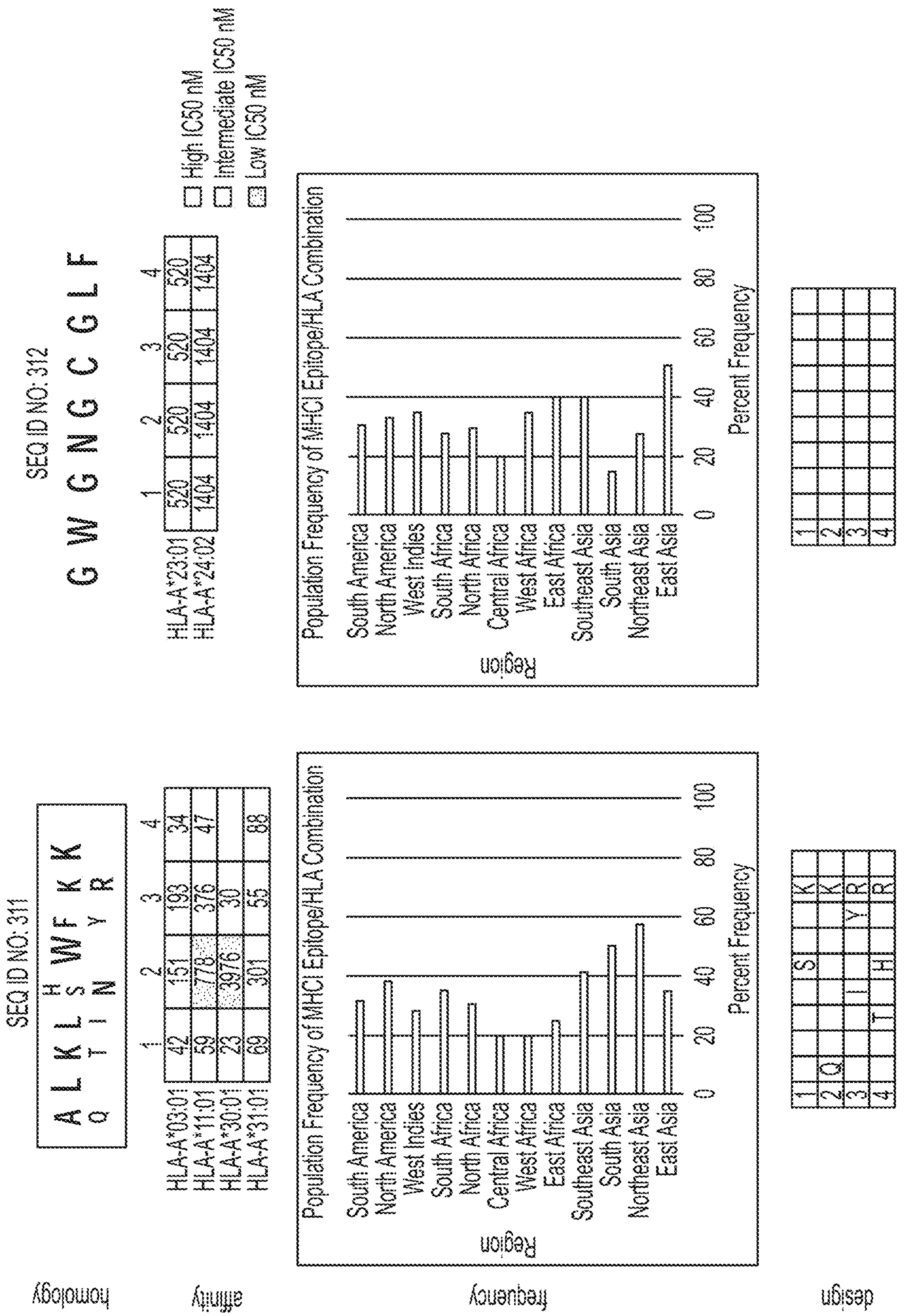
Figure 17A:
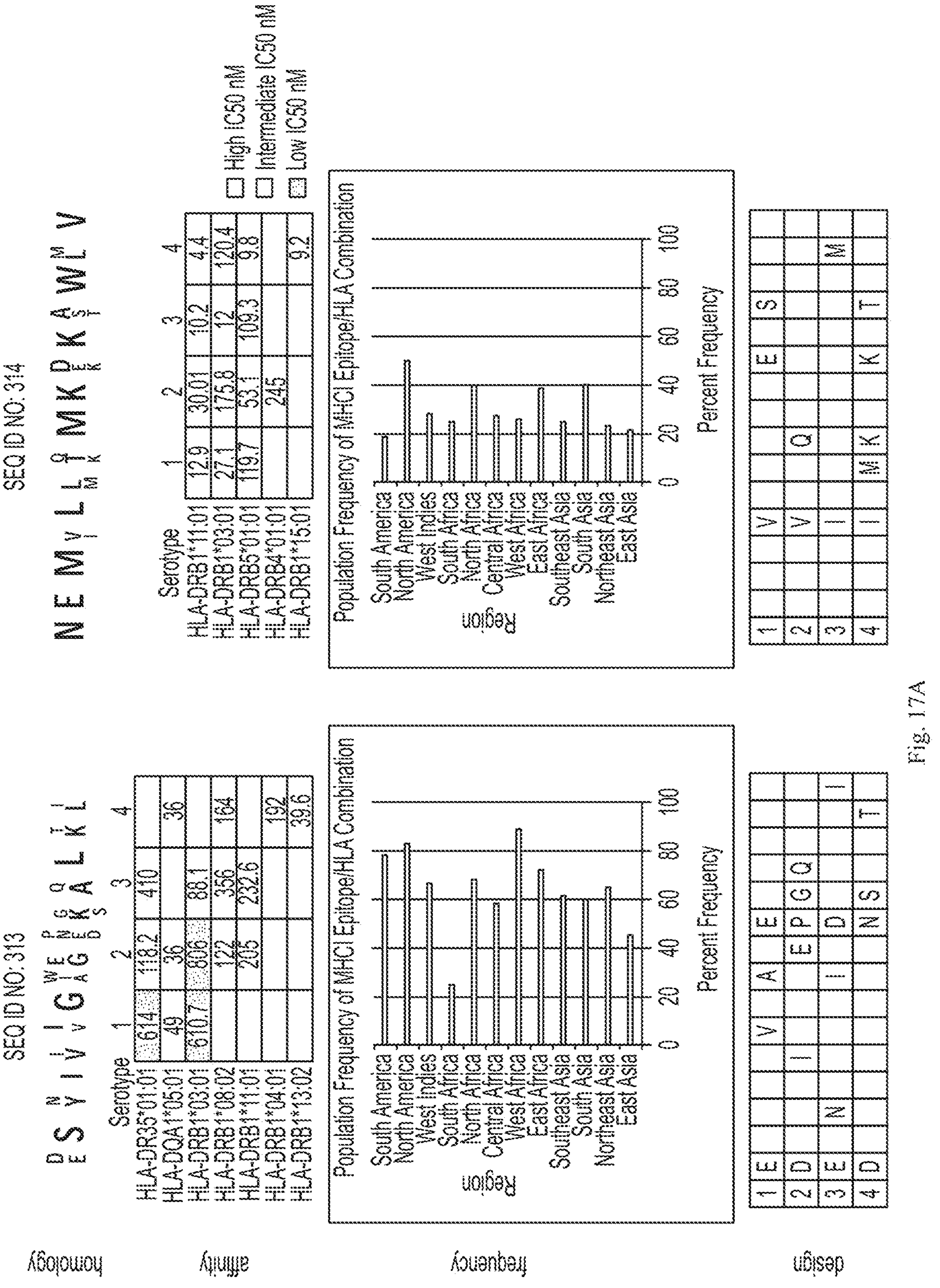

In order to design useful epitopes, publically available databases, such as the Immune Epitope Database (IEDB), may be used to predict immunogenic Dengue T cell epitopes showing strong homology across all 4 Dengue serotypes. For instance, the IEDB is a free database offering searching of experimental data characterizing antibody and T cell epitopes and assisting in the prediction and analysis of B cell and T cell epitopes. The Dengue peptides identified by database may be confirmed using peptides in MHC allele binding assays (such as those described in the Examples provided herein) and/or restimulation assays during the acute phase of Dengue infection (i.e. Day 7). Some examples of epitopes are shown in FIG. 15. These epitopes may be evaluated in test mice and using an assay such as that shown in FIG. 18.

Some embodiments of the present disclosure provide ZIKV vaccines, including combination vaccines, that include at least one ribonucleic acid (RNA) polynucleotide having an open reading frame encoding at least one ZIKV antigenic polypeptide or an immunogenic fragment or epitope thereof. Some embodiments of the present disclosure provide ZIKV combination vaccines that include at least one RNA polynucleotide having an open reading frame encoding two or more ZIKV antigenic polypeptides or an immunogenic fragment or epitope thereof. Some embodiments of the present disclosure provide ZIKV vaccines that include two or more RNA polynucleotides having an open reading frame encoding two or more ZIKV antigenic polypeptides or immunogenic fragments or epitopes thereof. The one or more ZIKV antigenic polypeptides may be encoded on a single RNA polynucleotide or may be encoded individually on multiple (e.g., two or more) RNA polynucleotides.

In some embodiments, the at least one RNA polynucleotide may encode at least one ZIKV antigenic polypeptide. In some instances the ZIKV antigenic polypeptide is an intact ZIKV peptide or other large antigen (i.e. greater than 25 amino acids in length). In any of these embodiments, the at least one RNA polynucleotide encodes a ZIKV polypeptide from a ZIKV serotype selected from MR 766, SPH2015 or ACD75819. For example, the ZIKV polypeptide may be one or more polypeptides encoded by SEQ ID NO: 67-134 or an immunogenic fragment or epitope thereof.

Zika virus (ZIKV) vaccines, including combination vaccines, as provided herein, comprise at least one (one or more) ribonucleic acid (RNA) polynucleotide having an open reading frame encoding at least one ZIKV antigenic polypeptide. In some embodiments, the ZIKV antigenic polypeptide is longer than 25 amino acids and shorter than 50 amino acids. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. Polypeptides may also comprise single chain or multichain polypeptides such as antibodies or insulin and may be associated or linked. Most commonly, disulfide linkages are found in multichain polypeptides. The term polypeptide may also apply to amino acid polymers in which at least one amino acid residue is an artificial chemical analogue of a corresponding naturally-occurring amino acid.

The generation of antigens that elicit a desired immune response (e.g. B and/or T-cell responses) against targeted polypeptide sequences in vaccine development remains a challenging task. The invention involves technology that overcome hurdles associated with vaccine development. Through the use of the technology of the invention, it is possible to tailor the desired immune response by selecting appropriate T or B cell epitopes which, by virtue of the fact that they are processed intra-cellularly, are able to be presented more effectively on MHC-1 or MHC-2 molecules (depending on whether they are T or B-cell epitope, respectively). In particular, the invention involves the generation of DENV concatemers of epitopes (particularly T cell epitopes) preferably interspersed with cleavage sites by proteases that are abundant in Antigen Presenting Cells (APCs). These methods mimic antigen processing and may lead to a more effective antigen presentation than can be achieved with peptide antigens.

The fact that the peptide epitopes of the invention are expressed from RNA as intracellular peptides provides advantages over prior art peptides that are delivered as exogenous peptides or as DNA. The RNA is delivered intra-cellularly and expresses the epitopes in proximity to the appropriate cellular machinery for processing the epitopes such that they will be recognized by the appropriate immune cells. Additionally, a targeting sequence will allow more specificity in the delivery of the peptide epitopes.

In some embodiments the DENY mRNA vaccine of the invention is a poly-epitopic RNA. Poly-epitopes consist of strings of epitopes on the same mRNA. The RNA sequences that code for the peptide epitopes may be interspersed by sequences that code for amino acid sequences recognized by proteolytic enzymes, by other linkers or linked directly.

A concatemeric peptide as used herein is a series of at least two peptide epitopes linked together to form the propeptide. In some embodiments a concatemeric peptide is composed of 3 or more, 4 or more, 5 or more 6 or more 7 or more, 8 or more, 9 or more peptide epitopes. In other embodiments the concatemeric peptide is composed of 1000 or less, 900 or less, 500 or less, 100 or less, 75 or less, 50 or less, 40 or less, 30 or less, 20 or less or 100 or less peptide epitopes. In yet other embodiments a concatemeric peptide has 3-100, 5-100, 10-100, 15-100, 20-100, 25-100, 30-100, 35-100, 40-100, 45-100, 50-100, 55-100, 60-100, 65-100, 70-100, 75-100, 80-100, 90-100, 5-50, 10-50, 15-50, 20-50, 25-50, 30-50, 35-50, 40-50, 45-50, 100-150, 100-200, 100-300, 100-400, 100-500, 50-500, 50-800, 50-1,000, or 100-1,000 peptide epitopes.

An epitope, also known as an antigenic determinant, as used herein is a portion of an antigen that is recognized by the immune system in the appropriate context, specifically by antibodies, B cells, or T cells. Epitopes include B cell epitopes and T cell epitopes. B-cell epitopes are peptide sequences which are required for recognition by specific antibody producing B-cells. B cell epitopes refer to a specific region of the antigen that is recognized by an antibody. The portion of an antibody that binds to the epitope is called a paratope. An epitope may be a conformational epitope or a linear epitope, based on the structure and interaction with the paratope. A linear, or continuous, epitope is defined by the primary amino acid sequence of a particular region of a protein. The sequences that interact with the antibody are situated next to each other sequentially on the protein, and the epitope can usually be mimicked by a single peptide. Conformational epitopes are epitopes that are defined by the conformational structure of the native protein. These epitopes may be continuous or discontinuous, i.e. components of the epitope can be situated on disparate parts of the protein, which are brought close to each other in the folded native protein structure.

T-cell epitopes are peptide sequences which, in association with proteins on APC, are required for recognition by specific T-cells. T cell epitopes are processed intracellularly and presented on the surface of APCs, where they are bound to MHC molecules including MHC class II and MHC class I.

The present disclosure, in some aspects, relates to a process of developing T or B cell concatemeric epitopes or concatemeric epitopes composed of both B and T cell epitopes. Several tools exist for identifying various peptide epitopes. For instance, epitopes can be identified using a free or commercial database (Lonza Epibase, antitope for example). Such tools are useful for predicting the most immunogenic epitopes within a target antigen protein. The selected peptides may then be synthesized and screened in human HLA panels, and the most immunogenic sequences are used to construct the mRNA polynucleotides encoding the concatemeric antigens. One strategy for mapping epitopes of Cytotoxic T-Cells based on generating equimolar mixtures of the four C-terminal peptides for each nominal 11-mer across your an protein. This strategy would produce a library antigen containing all the possible active CTL epitopes.

The peptide epitope may be any length that is reasonable for an epitope. In some embodiments the peptide epitope is 9-30 amino acids. In other embodiments the length is 9-22, 9-29, 9-28, 9-27, 9-26, 9-25, 9-24, 9-23, 9-21, 9-20, 9-19, 9-18, 10-22, 10-21, 10-20, 11-22, 22-21, 11-20, 12-22, 12-21, 12-20, 13-22, 13-21, 13-20, 14-19, 15-18, or 16-17 amino acids. In some embodiments, the optimal length of a peptide epitope may be obtained through the following procedure: synthesizing a V5 tag concatemer-test protease site, introducing it into DC cells (for example, using an RNA Squeeze procedure, lysing the cells, and then running an anti-V5 Western blot to assess the cleavage at protease sites.

In some embodiments, the RNA polynucleotide of the combination vaccine is encoded by at least one nucleic acid sequence selected from SEQ ID NO: 1-13 (CHIKV), 16, 18, 20, 22, 24, 25, 27, 28, 30, 31, 33, 34, 144-152 or 199-212 (DENY), and 48-66 (ZIKV). In some embodiments, the RNA polynucleotide of the combination vaccine is encoded by at least one fragment of a nucleic acid sequence selected from SEQ ID NO: 1-13 (CHIKV), 16, 18, 20, 22, 24, 25, 27, 28, 30, 31, 33, 34, 144-152 or 199-212 (DENY), and 48-66 (ZIKV). In some embodiments, the RNA polynucleotide of the combination vaccine is encoded by at least one epitope sequence of a nucleic acid sequence selected from SEQ ID NO: 1-13 (CHIKV), 16, 18, 20, 22, 24, 25, 27, 28, 30, 31, 33, 34, 144-152 or 199-212 (DENV), or 48-66 (ZIKV).

In particular embodiments, the RNA polynucleotide is encoded by any of SEQ ID NO: 1, 5, 10, and 12. In particular embodiments, the RNA polynucleotide is encoded by any of SEQ ID NO: 2, 4, 6 and 11. In particular embodiments, the RNA polynucleotide is encoded by any of SEQ ID NO: 7-9. In a particular embodiment, the RNA polynucleotide is encoded by SEQ ID NO: 3. In a particular embodiment, the RNA polynucleotide is encoded by SEQ ID NO: 13.

Nucleic acids (also referred to as polynucleotides) may be or may include, for example, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or chimeras or combinations thereof.

In some embodiments, polynucleotides of the present disclosure is or functions as a messenger RNA (mRNA). As used herein the term "messenger RNA" (mRNA) refers to any polynucleotide that encodes at least one polypeptide (a naturally-occurring, non-naturally-occurring, or modified polymer of amino acids) and can be translated to produce the encoded polypeptide in vitro, in vivo, in situ or ex vivo.

Traditionally, the basic components of an mRNA molecule include at least one coding region, a 5' untranslated region (UTR), and a 3' UTR. In some embodiments, the mRNA molecules further includes a 5' cap. In some embodiments, the mRNA further includes a polyA tail. Polynucleotides of the present disclosure may function as mRNA but are distinguished from wild-type mRNA in their functional and/or structural design features which serve to overcome existing problems of effective polypeptide production using nucleic-acid based therapeutics. Antigenic polypeptides (antigens) of the present disclosure may be encoded by polynucleotides translated in vitro, referred to as "in vitro translated" (IVT) polynucleotides.

The RNA polynucleotides of the present disclosure may be or comprise variant or mutant sequence. The term "polynucleotide variant" refers to a nucleotide molecule which differs in its nucleotide sequence from a native, wildtype, or reference sequence. The nucleotide sequence variants may possess substitutions, deletions, and/or insertions at certain positions within the nucleotide sequence, as compared to the corresponding native, wildtype or reference sequence. In some embodiments, the nucleotide variants possess at least 80% identity (homology) to a native, wildtype or reference sequence, for example, at least 80%, 81%, 82%, 83%, 84%, 85%, 86%, 87%, 88%, 89%, 90%, 91%, 92%, 93%, 94%, 95%, 96%, 97%, 98%, or 99% identity (homology) to a native, wildtype or reference sequence.

In some embodiments, the RNA polynucleotide is encoded by a nucleic acid sequence having at least 80%-85% sequence identity to any of SEQ ID NO: 1-14 (CHIKV), 16, 18, 20, 22, 24, 25, 27, 28, 30, 31, 33, 34, 144-152 or 199-212 (DENV), or 48-66 (ZIKV). In some embodiments, the RNA polynucleotide is encoded by a nucleic acid sequence having at least 86%-90% sequence identity to any of SEQ ID NO: 1-13 (CHIKV), 16, 18, 20, 22, 24, 25, 27, 28, 30, 31, 33, 34, 144-152 or 199-212 (DENY), or 48-66 (ZIKV). In some embodiments, the RNA polynucleotide is encoded by a nucleic acid sequence having at least 91%-95% sequence identity to any of SEQ ID NO: 1-13 (CHIKV), 16, 18, 20, 22, 24, 25, 27, 28, 30, 31, 33, 34, 144-152 or 199-212 (DENY), or 48-66 (ZIKV). In some embodiments, the RNA polynucleotide is encoded by a nucleic acid sequence having at least 96%-98% sequence identity to any of SEQ ID NO: 1-13 (CHIKV), 16, 18, 20, 22, 24, 25, 27, 28, 30, 31, 33, 34, 144-152 or 199-212 (DENY), or 48-66 (ZIKV). In some embodiments, the RNA polynucleotide is encoded by a nucleic acid sequence having at least 99% sequence identity to any of SEQ ID NO: 1-13 (CHIKV), 16, 18, 20, 22, 24, 25, 27, 28, 30, 31, 33, 34, 144-152 or 199-212 (DENY), or 48-66 (ZIKV).

In some embodiments, a polynucleotide of the present disclosure, e.g., polynucleotide variants, have less than 80% identity (homology) to a native, wildtype or reference sequence, for example, less than 80%, 79%, 78%, 77%, 76%, 75%, 74%, 73%, 72%, 71%, 70%, 69%, 68%, 67%, 66%, 65%, 64%, 63%, 62%, 61%, 60% or less identity (homology) to a native, wildtype or reference sequence. In some embodiments, polynucleotide of the invention, e.g., polynucleotide variants, have about 65% to about 85% identity to a native, wildtype or reference sequence, e.g., 65%-82%, 67%-81%, or 66%-80% identity to a native, wildtype or reference sequence.

Polynucleotides of the present disclosure, in some embodiments, are codon optimized. Codon optimization methods are known in the art and may be used as provided herein. Codon optimization, in some embodiments, may be used to match codon frequencies in target and host organisms to ensure proper folding; bias GC content to increase mRNA stability or reduce secondary structures; minimize tandem repeat codons or base runs that may impair gene construction or expression; customize transcriptional and translational control regions; insert or remove protein trafficking sequences; remove/add post translation modification sites in encoded protein (e.g. glycosylation sites); add, remove or shuffle protein domains; insert or delete restriction sites; modify ribosome binding sites and mRNA degradation sites; adjust translational rates to allow the various domains of the protein to fold properly; or to reduce or eliminate problem secondary structures within the polynucleotide. Codon optimization tools, algorithms and services are known in the art. Non-limiting examples include services from GeneArt (Life Technologies), DNA2.0 (Menlo Park Calif.) and/or proprietary methods. In some embodiments, the open reading frame (ORF) sequence is optimized using optimization algorithms.

In some embodiments, a codon optimized sequence shares less than 95% sequence identity to a naturally-occurring or wild-type sequence (e.g., a naturally-occurring or wild-type mRNA sequence encoding a polypeptide or protein of interest (e.g., an antigenic protein or polypeptide. In some embodiments, a codon optimized sequence shares less than 90% sequence identity to a naturally-occurring or wild-type sequence (e.g., a naturally-occurring or wild-type mRNA sequence encoding a polypeptide or protein of interest (e.g., an antigenic protein or polypeptide. In some embodiments, a codon optimized sequence shares less than 85% sequence identity to a naturally-occurring or wild-type sequence (e.g., a naturally-occurring or wild-type mRNA sequence encoding a polypeptide or protein of interest (e.g., an antigenic protein or polypeptide. In some embodiments, a codon optimized sequence shares less than 80% sequence identity to a naturally-occurring or wild-type sequence (e.g., a naturally-occurring or wild-type mRNA sequence encoding a polypeptide or protein of interest (e.g., an antigenic protein or polypeptide. In some embodiments, a codon optimized sequence shares less than 75% sequence identity to a naturally-occurring or wild-type sequence (e.g., a naturally-occurring or wild-type mRNA sequence encoding a polypeptide or protein of interest (e.g., an antigenic protein or polypeptide.

In some embodiments, a codon optimized sequence shares between 65% and 85% (e.g., between about 67% and about 85% or between about 67% and about 80%) sequence identity to a naturally-occurring or wild-type sequence (e.g., a naturally-occurring or wild-type mRNA sequence encoding a polypeptide or protein of interest (e.g., an antigenic protein or polypeptide. In some embodiments, a codon optimized sequence shares between 65% and 75 or about 80% sequence identity to a naturally-occurring or wild-type sequence (e.g., a naturally-occurring or wild-type mRNA sequence encoding a polypeptide or protein of interest (e.g., an antigenic protein or polypeptide.

In some embodiments, the RNA polynucleotides of the present disclosure may further comprise sequence comprising or encoding additional sequence, for example, one or more functional domain(s), one or more further regulatory sequence(s), an engineered 5' cap.

Thus, in some embodiments, the RNA vaccines comprise a 5'UTR element, an optionally codon optimized open reading frame, and a 3'UTR element, a poly(A) sequence and/or a polyadenylation signal wherein the RNA is not chemically modified.

In Vitro Transcription of RNA (e.g., mRNA)

The combination vaccine of the present disclosure comprise at least one RNA polynucleotide, such as a mRNA (e.g., modified mRNA). mRNA, for example, is transcribed in vitro from template DNA, referred to as an "in vitro transcription template." In some embodiments, an in vitro transcription template encodes a 5' untranslated (UTR) region, contains an open reading frame, and encodes a 3' UTR and a polyA tail. The particular nucleotide sequence composition and length of an in vitro transcription template will depend on the mRNA encoded by the template.

A "5' untranslated region" (UTR) refers to a region of an mRNA that is directly upstream (i.e., 5') from the start codon (i.e., the first codon of an mRNA transcript translated by a ribosome) that does not encode a polypeptide.

A "3' untranslated region" (UTR) refers to a region of an mRNA that is directly downstream (i.e., 3') from the stop codon (i.e., the codon of an mRNA transcript that signals a termination of translation) that does not encode a polypeptide.

An "open reading frame" is a continuous stretch of codons beginning with a start codon (e.g., methionine (ATG)), and ending with a stop codon (e.g., TAA, TAG or TGA) that encodes a polypeptide.

A "polyA tail" is a region of mRNA that is downstream, e.g., directly downstream (i.e., 3'), from the 3' UTR that contains multiple, consecutive adenosine monophosphates. A polyA tail may contain 10 to 300 adenosine monophosphates. For example, a polyA tail may contain 10, 20, 30, 40, 50, 60, 70, 80, 90, 100, 110, 120, 130, 140, 150, 160, 170, 180, 190, 200, 210, 220, 230, 240, 250, 260, 270, 280, 290 or 300 adenosine monophosphates. In some embodiments, a polyA tail contains 50 to 250 adenosine monophosphates. In a relevant biological setting (e.g., in cells, in vivo) the poly(A) tail functions to protect mRNA from enzymatic degradation, e.g., in the cytoplasm, and aids in transcription termination, export of the mRNA from the nucleus and translation.

In some embodiments a codon optimized RNA may, for instance, be one in which the levels of G/C are enhanced. The G/C-content of nucleic acid molecules may influence the stability of the RNA. RNA having an increased amount of guanine (G) and/or cytosine (C) residues may be functionally more stable than nucleic acids containing a large amount of adenine (A) and thymine (T) or uracil (U) nucleotides. WO02/098443 discloses a pharmaceutical composition containing an mRNA stabilized by sequence modifications in the translated region. Due to the degeneracy of the genetic code, the modifications work by substituting existing codons for those that promote greater RNA stability without changing the resulting amino acid. The approach is limited to coding regions of the RNA.

Antigens/Antigenic Polypeptides

In some embodiments, the Chikungunya antigenic polypeptide is a Chikungunya structural protein. The Chikungunya structural protein can be a CHIKV envelope (E) protein or a CHIKV capsid (C) protein. In some embodiments, the Chikungunya structural protein can be a CHIKV E1, E2, E3, 6K, or capsid (C) protein. In one embodiment, the Chikungunya structural protein is CHIKV E1. In another embodiment, the Chikungunya structural protein is CHIKV E2. In another embodiment, the Chikungunya structural protein is CHIKV E3. In another embodiment, the Chikungunya structural protein is CHIKV C. In another embodiment, the Chikungunya structural protein is CHIKV 6K.

In some embodiments, the Chikungunya antigenic polypeptide comprises the sequence of two or more Chikungunya structural proteins selected from E1, E2, E3, 6K, and C. The antigenic polypeptide can comprise the sequence of any combination of CHIKV structural proteins, including, for example, CHIKV E1 and E2; CHIKV E2 and E3; CHIKV E1 and E3; CHIKV E1, E2, and E3; CHIKV E1, E2, E3, and C; CHIKV E1, E2, E3, 6K, and C; CHIKV E1, 6K, E2;

CHIKV E2, 6K, E3; CHIKV E1, 6K, E3; and CHIKV E1, E2, E3, and 6K proteins. In one particular embodiment, the Chikungunya antigenic polypeptide comprises the sequence of the Chikungunya structural polyprotein: C-E3-E2-6K-E1.

In some embodiments, the Chikungunya antigenic polypeptide is a fragment of a Chikungunya structural protein. The Chikungunya structural protein fragment can be a CHIKV envelope (E) protein fragment or a CHIKV capsid (C) protein fragment. In some embodiments, the Chikungunya structural protein fragment can be a CHIKV E1, E2, E3, 6K, or capsid (C) protein fragment. In one embodiment, the Chikungunya structural protein fragment is CHIKV E1 fragment. In another embodiment, the Chikungunya structural protein fragment is CHIKV E2 fragment. In another embodiment, the Chikungunya structural protein fragment is CHIKV E3 fragment. In another embodiment, the Chikungunya structural protein fragment is a CHIKV C fragment. In another embodiment, the Chikungunya structural protein fragment is a CHIKV 6K fragment.

In some embodiments, the Chikungunya antigenic polypeptide comprises the sequence of two or more Chikungunya structural protein fragments selected from E1, E2, E3, 6K, and C protein fragments. The antigenic polypeptide can comprise the sequence of any combination of CHIKV structural protein fragments, including, for example, CHIKV E1 and E2 protein fragments; CHIKV E2 and E3 protein fragments; CHIKV E1 and E3 protein fragments; CHIKV E1, E2, and E3 protein fragments; CHIKV E1, E2, E3, and C protein fragments; CHIKV E1, E2, E3, 6K, and C protein fragments; CHIKV E1, 6K, and E2 protein fragments; CHIKV E2, 6K, and E3 protein fragments; CHIKV E1, 6K, and E3 protein fragments; and CHIKV E1, E2, E3, and 6K protein fragments. In one particular embodiment, the Chikungunya antigenic polypeptide comprises the sequence of a fragment of the Chikungunya structural polyprotein: C-E3-E2-6K-E1.

In some embodiments, the Chikungunya antigenic polypeptide comprises the sequence of two or more Chikungunya structural proteins in which the proteins are a combination of full-length protein(s) and fragment(s) selected from E1, E2, E3, 6K, and C full-length protein(s) and fragment(s). The Chikungunya antigenic polypeptide may comprise the sequence of any combination of full-length protein(s) and fragment(s) including, for example, CHIKV E1 and E2 full-length protein(s) and fragment(s); CHIKV E2 and E3 full-length protein(s) and fragment(s); CHIKV E1 and E3 full-length protein(s) and fragment(s); CHIKV E1, E2, and E3 full-length protein(s) and fragment(s); CHIKV E1, E2, E3, and C full-length protein(s) and fragments; CHIKV E1, E2, E3, and 6K full-length protein(s) and fragment(s); CHIKV E1, E2, E3, 6K, and C full-length protein(s) and fragment(s); CHIKV E1, 6K, and E2 full-length protein(s) and fragment(s); CHIKV E2, 6K, and E3 full-length protein(s) and fragment(s); and CHIKV E1, 6K, and E3 full-length protein(s) and fragment(s). In one particular embodiment, the Chikungunya antigenic polypeptide comprises the sequence of the Chikungunya structural polyprotein: C-E3-E2-6K-E1 in which the proteins are a combination of full-length protein(s) and fragment(s).

The polypeptide antigens of the present disclosure can be one or more full-length CHIKV protein antigens, one or more fragment antigens, one or more epitope antigens or any combination of sequences thereof. In some embodiments, the CHIKV antigenic polypeptide comprises 10-25 amino acids. In some embodiments, the CHIKV antigenic polypeptide comprises 26-50 amino acids. In some embodiments, the CHIKV antigenic polypeptide comprises 51-100 amino acids. In some embodiments, the CHIKV antigenic polypeptide comprises 101-200 amino acids. In some embodiments, the CHIKV antigenic polypeptide comprises 201-400 amino acids. In some embodiments, the CHIKV antigenic polypeptide comprises 401-500 amino acids. In some embodiments, the CHIKV antigenic polypeptide comprises 501-750 amino acids. In some embodiments, the CHIKV antigenic polypeptide comprises 751-1000 amino acids. In some embodiments, the CHIKV antigenic polypeptide comprises 1001-1500 amino acids. In some embodiments, the CHIKV antigenic polypeptide comprises 1501-2000 amino acids. In some embodiments, the CHIKV antigenic polypeptide comprises 2001-4000 amino acids.

The polypeptide antigens of the present disclosure can be one or more full-length DENV protein antigens, one or more fragment antigens, one or more epitope antigens or any combination of sequences thereof. In some embodiments, the DENV antigenic polypeptide comprises 10-25 amino acids. In some embodiments, the DENV antigenic polypeptide comprises 26-50 amino acids. In some embodiments, the DENV antigenic polypeptide comprises 51-100 amino acids. In some embodiments, the DENV antigenic polypeptide comprises 101-200 amino acids. In some embodiments, the DENV antigenic polypeptide comprises 201-400 amino acids. In some embodiments, the DENV antigenic polypeptide comprises 401-500 amino acids. In some embodiments, the DENV antigenic polypeptide comprises 501-750 amino acids. In some embodiments, the DENV antigenic polypeptide comprises 751-1000 amino acids. In some embodiments, the DENV antigenic polypeptide comprises 1001-1500 amino acids. In some embodiments, the DENV antigenic polypeptide comprises 1501-2000 amino acids. In some embodiments, the DENV antigenic polypeptide comprises 2001-4000 amino acids.

The polypeptide antigens of the present disclosure can be one or more full-length ZIKV protein antigens, one or more fragment antigens, one or more epitope antigens or any combination of sequences thereof. In some embodiments, the ZIKV antigenic polypeptide comprises 10-25 amino acids. In some embodiments, the ZIKV antigenic polypeptide comprises 26-50 amino acids. In some embodiments, the ZIKV antigenic polypeptide comprises 51-100 amino acids. In some embodiments, the ZIKV antigenic polypeptide comprises 101-200 amino acids. In some embodiments, the ZIKV antigenic polypeptide comprises 201-400 amino acids. In some embodiments, the ZIKV antigenic polypeptide comprises 401-500 amino acids. In some embodiments, the ZIKV antigenic polypeptide comprises 501-750 amino acids. In some embodiments, the ZIKV antigenic polypeptide comprises 751-1000 amino acids. In some embodiments, the ZIKV antigenic polypeptide comprises 1001-1500 amino acids. In some embodiments, the ZIKV antigenic polypeptide comprises 1501-2000 amino acids. In some embodiments, the ZIKV antigenic polypeptide comprises 2001-4000 amino acids.

The antigenic polypeptides include gene products, naturally occurring polypeptides, synthetic or engineered polypeptides, mutant polypeptides, homologs, orthologs, paralogs, fragments and other equivalents, variants, and analogs of the foregoing. A polypeptide may be a single molecule or may be a multi-molecular complex such as a dimer, trimer or tetramer. Polypeptides may also comprise single chain or multichain polypeptides such as antibodies or insulin and may be associated or linked. Most commonly, disulfide linkages are found in multichain polypeptides. The term polypeptide may also apply to amino acid polymers in which at least one amino acid residue is an artificial chemical analogue of a corresponding naturally-occurring amino acid.

The term "polypeptide variant" refers to molecules which differ in their amino acid sequence from a native, wildtype, or reference sequence. The amino acid sequence variants may possess substitutions, deletions, and/or insertions at certain positions within the amino acid sequence, as compared to a native, wildtype, or reference sequence. Ordinarily, variants possess at least 50% identity (homology) to a native, wildtype, or reference sequence. In some embodiments, variants possess at least 80%, or at least 90% identical (homologous) to a native, wildtype, or reference sequence.

Examples of natural variants that are encompassed by the present disclosure include CHIKV, DENY, and ZIKV structural polypeptides from different CHIKV genotypes, lineages, strains, and isolates. A phylogenetic tree of Chikungunya virus strains derived from complete concatenated open reading frames for the nonstructural and structural polyproteins shows key envelope glycoprotein E1 amino acid substitutions that facilitated (Indian Ocean lineage) or prevented (Asian lineage) adaptation to *Aedes albopictus*. There are membrane-bound and secreted forms of E1 and E2, as well as the full length polyprotein antigen, which retains the protein's native conformation. Additionally, the different Chikungunya genotypes can also yield different antigens, which are functional in the constructs of the invention. There are several Chikungunya genotypes: Indian Ocean, East/Central/South African (ECSA), Asian, West African, and the Brazilian isolates (ECSA/Asian). Thus, for example, natural variants that are encompassed by the present disclosure include, but is not limited to, CHIKV structural polypeptides from the following strains and isolates: TA53, SA76, UG82, 37997, IND-06, Ross, S27, M-713424, E1-A226V, E1-T98, IND-63-WB1, Gibbs 63-263, TH35, 1-634029, AF15561, IND-73-MH5, 653496, CO392-95, PO731460, MY0211MR/06/BP, SV0444-95, K0146-95, TSI-GSD-218-VR1, TSI-GSD-218, M127, M125, 6441-88, MY003IMR/06/BP, MY002IMR/06/BP, TR206/H804187, MY/06/37348, MY/06/37350, NC/2011-568, 1455-75, RSU1, 0706aTw, InDRE51CHIK, PR-S4, AMA2798/H804298, Hu/85/NR/001, PhH15483, 0706aTw, 0802aTw, MY019IMR/06/BP, PR-S6, PER160/H803609, 99659, JKT23574, 0811aTw, CHIK/SBY6/10, 2001908323-BDG E1, 2001907981-BDG E1, 2004904899-BDG E1, 2004904879-BDG E1, 2003902452-BDG E1, DH130003, 0804aTw, 2002918310-BDG E1, JC2012, chik-sy, 3807, 3462, Yap 13-2148, PR-S5, 0802aTw, MY019IMR/06/Bp, 0706aTw, PhH15483, Hu/85/NR/001, CHIKV-13-112A, InDRE 4CHIK, 0806aTw, 0712aTw, 3412-78, Yap 13-2039, LEIV-CHIKV/Moscow/l, DH130003, and 20039.

In some embodiments "variant mimics" are provided. As used herein, the term "variant mimic" is one which contains at least one amino acid that would mimic an activated sequence. For example, glutamate may serve as a mimic for phosphoro-threonine and/or phosphoro-serine. Alternatively, variant mimics may result in deactivation or in an inactivated product containing the mimic, for example, phenylalanine may act as an inactivating substitution for tyrosine; or alanine may act as an inactivating substitution for serine.

"Homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation. By "homologs" as it applies to polypeptide sequences means the corresponding sequence of other species having substantial identity to a second sequence of a second species.

"Analogs" is meant to include polypeptide variants which differ by one or more amino acid alterations, for example, substitutions, additions or deletions of amino acid residues that still maintain one or more of the properties of the parent or starting polypeptide.

The present disclosure provides several types of compositions that are polypeptide based, including variants and derivatives. These include, for example, substitutional, insertional, deletion and covalent variants and derivatives. The term "derivative" is used synonymously with the term "variant" but generally refers to a molecule that has been modified and/or changed in any way relative to a reference molecule or starting molecule.

As such, polynucleotides encoding peptides or polypeptides containing substitutions, insertions and/or additions, deletions and covalent modifications with respect to reference sequences, in particular the polypeptide sequences disclosed herein, are included within the scope of this disclosure. "Substitutional variants" when referring to polypeptides are those that have at least one amino acid residue in a native or starting sequence removed and a different amino acid inserted in its place at the same position. Substitutions may be single, where only one amino acid in the molecule has been substituted, or they may be multiple, where two or more amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Features" when referring to polypeptide or polynucleotide are defined as distinct amino acid sequence-based or nucleotide-based components of a molecule respectively. Features of the polypeptides encoded by the polynucleotides include surface manifestations, local conformational shape, folds, loops, half-loops, domains, half-domains, sites, termini or any combination thereof.

As used herein when referring to polypeptides the term "domain" refers to a motif of a polypeptide having one or more identifiable structural or functional characteristics or properties (e.g., binding capacity, serving as a site for protein-protein interactions).

As used herein when referring to polypeptides the terms "site" as it pertains to amino acid based embodiments is used synonymously with "amino acid residue" and "amino acid side chain." As used herein when referring to polynucleotides the terms "site" as it pertains to nucleotide based embodiments is used synonymously with "nucleotide." A site represents a position within a peptide or polypeptide or polynucleotide that may be modified, manipulated, altered, derivatized or varied within the polypeptide or polynucleotide based molecules.

As used herein the terms "termini" or "terminus" when referring to polypeptides or polynucleotides refers to an extremity of a polypeptide or polynucleotide respectively. Such extremity is not limited only to the first or final site of the polypeptide or polynucleotide but may include additional amino acids or nucleotides in the terminal regions. Polypeptide-based molecules may be characterized as having both an N-terminus (terminated by an amino acid with a free amino group (NH2)) and a C-terminus (terminated by an amino acid with a free carboxyl group (COOH)). Proteins are in some cases made up of multiple polypeptide chains brought together by disulfide bonds or by non-covalent forces (multimers, oligomers). These proteins have multiple N- and C-termini. Alternatively, the termini of the polypeptides may be modified such that they begin or end, as the case may be, with a non-polypeptide based moiety such as an organic conjugate.

As recognized by those skilled in the art, protein fragments, functional protein domains, and homologous proteins are also considered to be within the scope of polypeptides of interest. For example, provided herein is any protein fragment (meaning a polypeptide sequence at least one amino acid residue shorter than a reference polypeptide sequence but otherwise identical) of a reference protein 10, 20, 30, 40, 50, 60, 70, 80, 90, 100 or greater than 100 amino acids in length. In another example, any protein that includes a stretch of 20, 30, 40, 50, or 100 amino acids which are 40%, 50%, 60%, 70%, 80%, 90%, 95%, or 100% identical to any of the sequences described herein can be utilized in accordance with the disclosure. In some embodiments, a polypeptide includes 2, 3, 4, 5, 6, 7, 8, 9, 10, or more mutations as shown in any of the sequences provided or referenced herein.

Reference molecules (polypeptides or polynucleotides) may share a certain identity with the designed molecules (polypeptides or polynucleotides). The term "identity" as known in the art, refers to a relationship between the sequences of two or more peptides, polypeptides or polynucleotides, as determined by comparing the sequences. In the art, identity also means the degree of sequence relatedness between them as determined by the number of matches between strings of two or more amino acid residues or nucleosides. Identity measures the percent of identical matches between the smaller of two or more sequences with gap alignments (if any) addressed by a particular mathematical model or computer program (e.g., "algorithms"). Identity of related peptides can be readily calculated by known methods. Generally, variants of a particular polynucleotide or polypeptide have at least 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, et al (1997), "Gapped BLAST and PSI-BLAST: a new generation of protein database search programs", Nucleic Acids Res. 25:3389-3402). A general global alignment technique based on dynamic programming is the Needleman-Wunsch algorithm. More recently a Fast Optimal Global Sequence Alignment Algorithm (FOGSAA) has been developed that purportedly produces global alignment of nucleotide and protein sequences faster than other optimal global alignment methods, including the Needleman-Wunsch algorithm. Other tools are described herein, specifically in the definition of "identity" below.

As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). Two polynucleotide sequences are considered homologous if the polypeptides they encode are at least 50%, 60%, 70%, 80%, 90%, 95%, or even 99% for at least one stretch of at least 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. Two protein sequences are considered homologous if the proteins are at least 50%, 60%, 70%, 80%, or 90% identical for at least one stretch of at least 20 amino acids.

The term "identity" refers to the overall relatedness between polymeric molecules, for example, between polynucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., Nucleic Acids Research, 12(1), 387 (1984)), BLASTP, BLASTN, and FASTA Altschul, S. F. et al., J. Molec. Biol., 215, 403 (1990)).

In some embodiments, the polypeptides further comprise additional sequences or functional domains. For example, the CHIKV polypeptides of the present disclosure may comprise one or more linker sequences. In some embodiments, the CHIKV of the present invention may comprise a polypeptide tag, such as an affinity tag (chitin binding protein (CBP), maltose binding protein (MBP), glutathione-S-transferase (GST), SBP-tag, Strep-tag, AviTag, Calmodulin-tag); solubilization tag; chromatography tag (polyanionic amino acid tag, such as FLAG-tag); epitope tag (short peptide sequences that bind to high-affinity antibodies, such as V5-tag, Myc-tag, VSV-tag, Xpress tag, E-tag, S-tag, and HA-tag); fluorescence tag (e.g., GFP). In some embodiments, the CHIKV of the present invention may comprise an amino acid tag, such as one or more lysines, histidines, or glutamates, which can be added to the polypeptide sequences (e.g., at the N-terminal or C-terminal ends). Lysines can be used to increase peptide solubility or to allow for biotinylation. Protein and amino acid tags are peptide sequences genetically grafted onto a recombinant protein. Sequence tags are attached to proteins for various purposes, such as peptide purification, identification, or localization, for use in various applications including, for example, affinity purification, protein array, western blotting, immunofluorescence, and immunoprecipitation. Such tags are subsequently removable by chemical agents or by enzymatic means, such as by specific proteolysis or intein splicing.

Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

Multiprotein and Multicomponent Vaccines

The present disclosure encompasses CHIKV vaccines, DENV vaccines, ZIKV vaccines, CHIKV/DENV vaccines, CHIKV/ZIKV vaccines, ZIKV/DENV vaccines, and CHIKV/DENV/ZIKV vaccines comprising one or multiple RNA (e.g., mRNA) polynucleotides, each encoding a single antigenic polypeptide, as well as vaccines comprising a single RNA polynucleotide encoding more than one antigenic polypeptide (e.g., as a fusion polypeptide). Thus, it should be understood that a vaccine composition comprising a RNA polynucleotide having an open reading frame encoding a first antigenic polypeptide and a RNA polynucleotide having an open reading frame encoding a second antigenic polypeptide encompasses (a) vaccines that comprise a first RNA polynucleotide encoding a first antigenic polypeptide and a second RNA polynucleotide encoding a second antigenic polypeptide, and (b) vaccines that comprise a single RNA polynucleotide encoding a first and second antigenic polypeptide (e.g., as a fusion polypeptide). RNA vaccines of the present disclosure, in some embodiments, comprise 2-10 (e.g., 2, 3, 4, 5, 6, 7, 8, 9 or 10), or more, RNA polynucleotides having an open reading frame, each of which encodes a different antigenic polypeptide (or a single RNA polynucleotide encoding 2-10, or more, different antigenic polypeptides). In some embodiments, a RNA vaccine comprises a RNA polynucleotide having an open reading frame encoding a capsid protein, a RNA polynucleotide having an open reading frame encoding a premembrane/membrane protein, and a RNA polynucleotide having an open reading frame encoding a envelope protein. In some embodiments, a RNA vaccine comprises a RNA polynucleotide having an open reading frame encoding a capsid protein and a RNA polynucleotide having an open reading frame encoding a premembrane/membrane protein. In some embodiments, a RNA vaccine comprises a RNA polynucleotide having an open reading frame encoding a capsid protein and a RNA polynucleotide having an open reading frame encoding a envelope protein. In some embodiments, a RNA vaccine comprises a RNA polynucleotide having an open reading frame encoding a premembrane/membrane protein and a RNA polynucleotide having an open reading frame encoding a envelope protein.

Signal Peptides

In some embodiments, a RNA polynucleotide encodes an antigenic polypeptide fused to a signal peptide (e.g., SEQ ID NO: 125, 126, 128 or 131). The signal peptide may be fused at the N-terminus or the C-terminus of the antigenic polypeptide. In some embodiments, antigenic polypeptides encoded by CHIKV, DENV and/or ZIKV nucleic acids comprise a signal peptide. Signal peptides, comprising the N-terminal 15-60 amino acids of proteins, are typically needed for the translocation across the membrane on the secretory pathway and thus universally control the entry of most proteins both in eukaryotes and prokaryotes to the secretory pathway. Signal peptides generally include of three regions: an N-terminal region of differing length, which usually comprises positively charged amino acids; a hydrophobic region; and a short carboxy-terminal peptide region. In eukaryotes, the signal peptide of a nascent precursor protein (pre-protein) directs the ribosome to the rough endoplasmic reticulum (ER) membrane and initiates the transport of the growing peptide chain across it. The signal peptide is not responsible for the final destination of the mature protein, however. Secretory proteins devoid of further address tags in their sequence are by default secreted to the external environment. Signal peptides are cleaved from precursor proteins by an endoplasmic reticulum (ER)-resident signal peptidase or they remain uncleaved and function as a membrane anchor. During recent years, a more advanced view of signal peptides has evolved, showing that the functions and immunodominance of certain signal peptides are much more versatile than previously anticipated.

Proteins encoded by the ZIKV genome, e.g., the ZIKV Envelope protein, contain a signal peptide at the N-terminus to facilitate protein targeting to the ER for processing. ER processing produces a mature Envelope protein, wherein the signal peptide is cleaved, typically by a signal peptidase of the host cell. A signal peptide may also facilitate the targeting of the protein to the cell membrane.

CHIKV vaccines, DENV vaccines, ZIKV vaccines, CHIKV/DENV vaccines, CHIKV/ZIKV vaccines, ZIKV/DENV vaccines, and CHIKV/DENV/ZIKV vaccines of the present disclosure may comprise, for example, RNA polynucleotides encoding an artificial signal peptide, wherein the signal peptide coding sequence is operably linked to and is in frame with the coding sequence of the CHIKV, DENV and/or ZIKV antigenic polypeptide. Thus, CHIKV vaccines, DENV vaccines, ZIKV vaccines, CHIKV/DENV vaccines, CHIKV/ZIKV vaccines, ZIKV/DENV vaccines, and CHIKV/DENV/ZIKV vaccines of the present disclosure, in some embodiments, produce an antigenic polypeptide comprising a CHIKV, DENV and/or ZIKV antigenic polypeptide fused to a signal peptide. In some embodiments, a signal peptide is fused to the N-terminus of the CHIKV, DENV and/or ZIKV antigenic polypeptide. In some embodiments, a signal peptide is fused to the C-terminus of the CHIKV, DENV and/or ZIKV antigenic polypeptide.

In some embodiments, the signal peptide fused to an antigenic polypeptide is an artificial signal peptide. In some embodiments, an artificial signal peptide fused to an antigenic polypeptide encoded by a RNA vaccine is obtained from an immunoglobulin protein, e.g., an IgE signal peptide or an IgG signal peptide. In some embodiments, a signal peptide fused to an antigenic polypeptide encoded by a RNA vaccine is an Ig heavy chain epsilon-1 signal peptide (IgE HC SP) having the sequence of: MDWTWILFLVAAATRVHS (SEQ ID NO: 126). In some embodiments, a signal peptide fused to a ZIKV antigenic polypeptide encoded by the ZIKV RNA vaccine is an $IgG_k$ chain V-III region HAH signal peptide ($IgG_k$ SP) having the sequence of METPAQLLFLLLLWLPDTTG (SEQ ID NO: 125). In some embodiments, a signal peptide fused to an antigenic polypeptide encoded by a RNA vaccine has an amino acid sequence set forth in SEQ ID NO: 125, 126, 128 or 131. The examples disclosed herein are not meant to be limiting and any signal peptide that is known in the art to facilitate targeting of a protein to ER for processing and/or targeting of a protein to the cell membrane may be used in accordance with the present disclosure.

A signal peptide may have a length of 15-60 amino acids. For example, a signal peptide may have a length of 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 amino acids. In some embodiments, a signal peptide may have a length of 20-60, 25-60, 30-60, 35-60, 40-60, 45-60, 50-60, 55-60, 15-55, 20-55, 25-55, 30-55, 35-55, 40-55, 45-55, 50-55, 15-50, 20-50, 25-50, 30-50, 35-50, 40-50, 45-50, 15-45, 20-45, 25-45, 30-45, 35-45, 40-45, 15-40, 20-40, 25-40, 30-40, 35-40, 15-35, 20-35, 25-35, 30-35, 15-30, 20-30, 25-30, 15-25, 20-25, or 15-20 amino acids.

Non-limiting examples of antigenic polypeptides fused to signal peptides, which are encoded by a ZIKV RNA vaccine of the present disclosure, may be found in Table 31, SEQ ID NO: 48-59.

A signal peptide is typically cleaved from the nascent polypeptide at the cleavage junction during ER processing, as illustrated in FIG. 26. The mature ZIKV antigenic polypeptide produce by a ZIKV RNA vaccine, for example, typically does not comprise a signal peptide.

Chemical Modifications

In some embodiments, the RNA vaccines of the present disclosure, in some embodiments, comprise at least one ribonucleic acid (RNA) polynucleotide having an open reading frame encoding at least one CHIKV, DENV and/or ZIKV antigenic polypeptide that comprises at least one chemical modification.

The terms "chemical modification" and "chemically modified" refer to modification with respect to adenosine (A), guanosine (G), uridine (U), thymidine (T) or cytidine (C) ribonucleosides or deoxyribnucleosides in at least one of their position, pattern, percent or population. Generally, these terms do not refer to the ribonucleotide modifications in naturally occurring 5'-terminal mRNA cap moieties. With respect to a polypeptide, the term "modification" refers to a modification relative to the canonical set 20 amino acids. RNA polynucleotides, as provided herein, are also considered "modified" of they contain amino acid substitutions, insertions or a combination of substitutions and insertions.

Polynucleotides (e.g., RNA polynucleotides, such as mRNA polynucleotides), in some embodiments, comprise various (more than one) different modifications. In some embodiments, a particular region of a polynucleotide contains one, two or more (optionally different) nucleoside or nucleotide modifications. In some embodiments, a modified RNA polynucleotide (e.g., a modified mRNA polynucleotide), introduced to a cell or organism, exhibits reduced degradation in the cell or organism, respectively, relative to an unmodified polynucleotide. In some embodiments, a modified RNA polynucleotide (e.g., a modified mRNA polynucleotide), introduced into a cell or organism, may exhibit reduced immunogenicity in the cell or organism, respectively (e.g., a reduced innate response).

Modifications of polynucleotides include, without limitation, those described herein. Polynucleotides (e.g., RNA polynucleotides, such as mRNA polynucleotides) may comprise modifications that are naturally-occurring, non-naturally-occurring or the polynucleotide may comprise a combination of naturally-occurring and non-naturally-occurring modifications. Polynucleotides may include any useful modification, for example, of a sugar, a nucleobase, or an internucleoside linkage (e.g., to a linking phosphate, to a phosphodiester linkage or to the phosphodiester backbone).

Polynucleotides (e.g., RNA polynucleotides, such as mRNA polynucleotides), in some embodiments, comprise non-natural modified nucleotides that are introduced during synthesis or post-synthesis of the polynucleotides to achieve desired functions or properties. The modifications may be present on an internucleotide linkages, purine or pyrimidine bases, or sugars. The modification may be introduced with chemical synthesis or with a polymerase enzyme at the terminal of a chain or anywhere else in the chain. Any of the regions of a polynucleotide may be chemically modified.

The present disclosure provides for modified nucleosides and nucleotides of a polynucleotide (e.g., RNA polynucleotides, such as mRNA polynucleotides). A "nucleoside" refers to a compound containing a sugar molecule (e.g., a pentose or ribose) or a derivative thereof in combination with an organic base (e.g., a purine or pyrimidine) or a derivative thereof (also referred to herein as "nucleobase"). A nucleotide" refers to a nucleoside, including a phosphate group. Modified nucleotides may by synthesized by any useful method, such as, for example, chemically, enzymatically, or recombinantly, to include one or more modified or non-natural nucleosides. Polynucleotides may comprise a region or regions of linked nucleosides. Such regions may have variable backbone linkages. The linkages may be standard phosphodiester linkages, in which case the polynucleotides would comprise regions of nucleotides.

Modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil. Any combination of base/sugar or linker may be incorporated into polynucleotides of the present disclosure.

The skilled artisan will appreciate that, except where otherwise noted, polynucleotide sequences set forth in the instant application will recite "T"s in a representative DNA sequence but where the sequence represents RNA, the "T"s would be substituted for "U"s.

Modifications of polynucleotides (e.g., RNA polynucleotides, such as mRNA polynucleotides) that are useful in the vaccines of the present disclosure include, but are not limited to the following: 2-methylthio-N6-(cis-hydroxyisopentenyl)adenosine; 2-methylthio-N6-methyladenosine; 2-methylthio-N6-threonyl carbamoyladenosine; N6-glycinylcarbamoyladenosine; N6-isopentenyladenosine; N6-methyladenosine; N6-threonylcarbamoyladenosine; 1,2'-O-dimethyladenosine; 1-methyladenosine; 2'-O-methyladenosine; 2'-O-ribosyladenosine (phosphate); 2-methyladenosine; 2-methylthio-N6 isopentenyladenosine; 2-methylthio-N6-hydroxynorvalyl carbamoyladenosine; 2'-O-methyladenosine; 2'-O-ribosyladenosine (phosphate); Isopentenyladenosine; N6-(cis-hydroxyisopentenyl)adenosine; N6,2'-O-dimethyladenosine; N6,2'-O-dimethyladenosine; N6,N6,2'-O-trimethyladenosine; N6,N6-dimethyladenosine; N6-acetyladenosine; N6-hydroxynorvalylcarbamoyladenosine; N6-methyl-N6-threonylcarbamoyladenosine; 2-methyladenosine; 2-methylthio-N6-isopentenyladenosine; 7-deaza-adenosine; N1-methyl-adenosine; N6, N6 (dimethyl)adenine; N6-cis-hydroxy-isopentenyl-adenosine; α-thio-adenosine; 2 (amino)adenine; 2 (aminopropyl)adenine; 2 (methylthio) N6 (isopentenyl)adenine; 2-(alkyl) adenine; 2-(aminoalkyl)adenine; 2-(aminopropyl)adenine; 2-(halo)adenine; 2-(halo)adenine; 2-(propyl)adenine; 2'-Amino-2'-deoxy-ATP; 2'-Azido-2'-deoxy-ATP; 2'-Deoxy-2'-a-aminoadenosine TP; 2'-Deoxy-2'-a-azidoadenosine TP; 6 (alkyl)adenine; 6 (methyl)adenine; 6-(alkyl)adenine; 6-(methyl)adenine; 7 (deaza)adenine; 8 (alkenyl)adenine; 8 (alkynyl)adenine; 8 (amino)adenine; 8 (thioalkyl)adenine; 8-(alkenyl)adenine; 8-(alkyl)adenine; 8-(alkynyl)adenine; 8-(amino)adenine; 8-(halo)adenine; 8-(hydroxyl)adenine; 8-(thioalkyl)adenine; 8-(thiol)adenine; 8-azido-adenosine; aza adenine; deaza adenine; N6 (methyl)adenine; N6-(isopentyl)adenine; 7-deaza-8-aza-adenosine; 7-methyladenine; 1-Deazaadenosine TP; 2'Fluoro-N6-Bz-deoxyadenosine TP; 2'-OMe-2-Amino-ATP; 2'O-methyl-N6-Bz-deoxyadenosine TP; 2'-a-Ethynyladenosine TP; 2-aminoadenine; 2-Aminoadenosine TP; 2-Amino-ATP; 2'-a-Trifluoromethyladenosine TP; 2-Azidoadenosine TP; 2'-b-Ethynyladenosine TP; 2-Bromoadenosine TP; 2'-b-Trifluoromethyladenosine TP; 2-Chloroadenosine TP; 2'-Deoxy-2',2'-difluoroadenosine TP; 2'-Deoxy-2'-a-mercaptoadenosine TP; 2'-Deoxy-2'-a-thiomethoxyadenosine TP; 2'-Deoxy-2'-b-aminoadenosine TP; 2'-Deoxy-2'-b-azidoadenosine TP; 2'-Deoxy-2'-b-bromoadenosine TP; 2'-Deoxy-2'-b-chloroadenosine TP; 2'-Deoxy-2'-b-fluoroadenosine TP; 2'-Deoxy-2'-b-iodoadenosine TP; 2'-Deoxy-2'-b-mercaptoadenosine TP; 2'-Deoxy-2'-b-thiomethoxyadenosine TP; 2-Fluoroadenosine TP; 2-Iodoadenosine TP; 2-Mercaptoadenosine TP; 2-methoxy-adenine; 2-methylthio-adenine; 2-Trifluoromethyladenosine TP; 3-Deaza-3-bromoadenosine TP; 3-Deaza-3-chloroadenosine TP; 3-Deaza-3-fluoroadenosine TP; 3-Deaza-3-iodoadenosine TP; 3-Deazaadenosine TP; 4'-Azidoadenosine TP; 4'-Carbocyclic adenosine TP; 4'-Ethynyladenosine TP; 5'-Homo-adenosine TP; 8-Aza-ATP; 8-bromo-adenosine TP; 8-Trifluoromethyladenosine TP; 9-Deazaadenosine TP; 2-aminopurine; 7-deaza-2,6-diaminopurine; 7-deaza-8-aza-2,6-diaminopurine; 7-deaza-8-aza-2-aminopurine; 2,6-diaminopurine; 7-deaza-8-aza-adenine, 7-deaza-2-aminopurine; 2-thiocytidine; 3-methylcytidine; 5-formylcytidine; 5-hydroxymethylcytidine; 5-methylcytidine; N4-acetylcytidine; 2'-O-methylcytidine; 2'-O-methylcytidine; 5,2'-O-dimethylcytidine; 5-formyl-2'-O-methylcytidine; Lysidine; N4,2'-O-dimethylcytidine; N4-acetyl-2'-O-methylcytidine; N4-methylcytidine; N4,N4-Dimethyl-2'-OMe-Cytidine TP; 4-methylcytidine; 5-aza-cytidine; Pseudo-iso-cytidine; pyrrolo-cytidine; α-thio-cytidine; 2-(thio)cytosine; 2'-Amino-2'-deoxy-CTP; 2'-Azido-2'-deoxy-CTP; 2'-Deoxy-2'-a-aminocytidine TP; 2'-Deoxy-2'-a-azidocytidine TP; 3 (deaza) 5 (aza)cytosine; 3 (methyl)cytosine; 3-(alkyl)cytosine; 3-(deaza) 5 (aza)cytosine; 3-(methyl)cytidine; 4,2'-O-dimethylcytidine; 5 (halo)cytosine; 5 (methyl)cytosine; 5 (propynyl)cytosine; 5 (trifluoromethyl)cytosine; 5-(alkyl)cytosine; 5-(alkynyl)cytosine; 5-(halo)cytosine; 5-(propynyl) cytosine; 5-(trifluoromethyl)cytosine; 5-bromo-cytidine; 5-iodo-cytidine; 5-propynyl cytosine; 6-(azo)cytosine; 6-aza-cytidine; aza cytosine; deaza cytosine; N4 (acetyl) cytosine; 1-methyl-1-deaza-pseudoisocytidine; 1-methyl-pseudoisocytidine; 2-methoxy-5-methyl-cytidine; 2-methoxy-cytidine; 2-thio-5-methyl-cytidine; 4-methoxy-1-methyl-pseudoisocytidine; 4-methoxy-pseudoisocytidine; 4-thio-1-methyl-1-deaza-pseudoisocytidine; 4-thio-1-methyl-pseudoisocytidine; 4-thio-pseudoisocytidine; 5-aza-zebularine; 5-methyl-zebularine; pyrrolo-pseudoisocytidine; Zebularine; (E)-5-(2-Bromo-vinyl)cytidine TP; 2,2'-anhydro-cytidine TP hydrochloride; 2'Fluor-N4-Bz-cytidine TP; 2'Fluoro-N4-Acetyl-cytidine TP; 2'-O-Methyl-N4-Acetyl-cytidine TP; 2'O-methyl-N4-Bz-cytidine TP; 2'-a-Ethynylcytidine TP; 2'-a-Trifluoromethylcytidine TP; 2'-b-Ethynylcytidine TP; 2'-b-Trifluoromethylcytidine TP; 2'-Deoxy-2',2'-difluorocytidine TP; 2'-Deoxy-2'-a-mercaptocytidine TP; 2'-Deoxy-2'-a-thiomethoxycytidine TP; 2'-Deoxy-2'-b-aminocytidine TP; 2'-Deoxy-2'-b-azidocytidine TP; 2'-Deoxy-2'-b-bromocytidine TP; 2'-Deoxy-2'-b-chlorocytidine TP; 2'-Deoxy-2'-b-fluorocytidine TP; 2'-Deoxy-2'-b-iodocytidine TP; 2'-Deoxy-2'-b-mercaptocytidine TP; 2'-Deoxy-2'-b-thiomethoxycytidine TP; 2'-O-Methyl-5-(1-propynyl)cytidine TP; 3'-Ethynylcytidine TP; 4'-Azidocytidine TP; 4'-Carbocyclic cytidine TP; 4'-Ethynylcytidine TP; 5-(1-Propynyl)ara-cytidine TP; 5-(2-Chloro-phenyl)-2-thiocytidine TP; 5-(4-Amino-phenyl)-2-thiocytidine TP; 5-Aminoallyl-CTP; 5-Cyanocytidine TP; 5-Ethynylara-cytidine TP; 5-Ethynylcytidine TP; 5'-Homo-cytidine TP; 5-Methoxycytidine TP; 5-Trifluoromethyl-Cytidine TP; N4-Amino-cytidine TP; N4-Benzoyl-cytidine TP; Pseudoisocytidine; 7-methylguanosine; N2,2'-O-dimethylguanosine; N2-methylguanosine; Wyosine; 1,2'-O-dimethylguanosine; 1-methylguanosine; 2'-O-methylguanosine; 2'-O-ribosylguanosine (phosphate); 2'-O-methylguanosine; 2'-O-ribosylguanosine (phosphate); 7-aminomethyl-7-deazaguanosine; 7-cyano-7-deazaguanosine; Archaeosine; Methylwyosine; N2,7-dimethylguanosine; N2,N2,2'-O-trimethylguanosine; N2,N2,7-trimethylguanosine; N2,N2-dimethylguanosine; N2,7,2'-O-trimethylguanosine; 6-thioguanosine; 7-deaza-guanosine; 8-oxo-guanosine; N1-methyl-guanosine; α-thio-guanosine; 2 (propyl)guanine;

2-(alkyl)guanine; 2'-Amino-2'-deoxy-GTP; 2'-Azido-2'-deoxy-GTP; 2'-Deoxy-2'-a-aminoguanosine TP; 2'-Deoxy-2'-a-azidoguanosine TP; 6 (methyl)guanine; 6-(alkyl)guanine; 6-(methyl)guanine; 6-methyl-guanosine; 7 (alkyl)guanine; 7 (deaza)guanine; 7 (methyl)guanine; 7-(alkyl)guanine; 7-(deaza)guanine; 7-(methyl)guanine; 8 (alkyl)guanine; 8 (alkynyl)guanine; 8 (halo)guanine; 8 (thioalkyl)guanine; 8-(alkenyl)guanine; 8-(alkyl)guanine; 8-(alkynyl)guanine; 8-(amino)guanine; 8-(halo)guanine; 8-(hydroxyl)guanine; 8-(thioalkyl)guanine; 8-(thiol)guanine; aza guanine; deaza guanine; N (methyl)guanine; N-(methyl)guanine; 1-methyl-6-thio-guanosine; 6-methoxy-guanosine; 6-thio-7-deaza-8-aza-guanosine; 6-thio-7-deaza-guanosine; 6-thio-7-methyl-guanosine; 7-deaza-8-aza-guanosine; 7-methyl-8-oxo-guanosine; N2,N2-dimethyl-6-thio-guanosine; N2-methyl-6-thio-guanosine; 1-Me-GTP; 2'Fluoro-N2-isobutyl-guanosine TP; 2'O-methyl-N2-isobutyl-guanosine TP; 2'-a-Ethynylguanosine TP; 2'-a-Trifluoromethylguanosine TP; 2'-b-Ethynylguanosine TP; 2'-b-Trifluoromethylguanosine TP; 2'-Deoxy-2',2'-difluoroguanosine TP; 2'-Deoxy-2'-a-mercaptoguanosine TP; 2'-Deoxy-2'-a-thiomethoxyguanosine TP; 2'-Deoxy-2'-b-aminoguanosine TP; 2'-Deoxy-2'-b-azidoguanosine TP; 2'-Deoxy-2'-b-bromoguanosine TP; 2'-Deoxy-2'-b-chloroguanosine TP; 2'-Deoxy-2'-b-fluoroguanosine TP; 2'-Deoxy-2'-b-iodoguanosine TP; 2'-Deoxy-2'-b-mercaptoguanosine TP; 2'-Deoxy-2'-b-thiomethoxyguanosine TP; 4'-Azidoguanosine TP; 4'-Carbocyclic guanosine TP; 4'-Ethynylguanosine TP; 5'-Homo-guanosine TP; 8-bromo-guanosine TP; 9-Deazaguanosine TP; N2-isobutyl-guanosine TP; 1-methylinosine; Inosine; 1,2'-O-dimethylinosine; 2'-O-methylinosine; 7-methylinosine; 2'-O-methylinosine; Epoxyqueuosine; galactosyl-queuosine; Mannosylqueuosine; Queuosine; allyamino-thymidine; aza thymidine; deaza thymidine; deoxy-thymidine; 2'-O-methyluridine; 2-thiouridine; 3-methyluridine; 5-carboxymethyluridine; 5-hydroxyuridine; 5-methyluridine; 5-taurinomethyl-2-thiouridine; 5-taurinomethyluridine; Dihydrouridine; Pseudouridine; (3-(3-amino-3-carboxypropyl)uridine; 1-methyl-3-(3-amino-5-carboxypropyl)pseudouridine; 1-methylpseduouridine; 1-methyl-pseudouridine; 2'-O-methyluridine; 2'-O-methylpseudouridine; 2'-O-methyluridine; 2-thio-2'-O-methyluridine; 3-(3-amino-3-carboxypropyl)uridine; 3,2'-O-dimethyluridine; 3-Methyl-pseudo-Uridine TP; 4-thiouridine; 5-(carboxyhydroxymethyl)uridine; 5-(carboxyhydroxymethyl)uridine methyl ester; 5,2'-O-dimethyluridine; 5,6-dihydro-uridine; 5-aminomethyl-2-thiouridine; 5-carbamoylmethyl-2'-O-methyluridine; 5-carbamoylmethyluridine; 5-carboxyhydroxymethyluridine; 5-carboxyhydroxymethyluridine methyl ester; 5-carboxymethylaminomethyl-2'-O-methyluridine; 5-carboxymethylaminomethyl-2-thiouridine; 5-carboxymethylaminomethyl-2-thiouridine; 5-carboxymethylaminomethyluridine; 5-carboxymethylaminomethyluridine; 5-Carbamoylmethyluridine TP; 5-methoxycarbonylmethyl-2'-O-methyluridine; 5-methoxycarbonylmethyl-2-thiouridine; 5-methoxycarbonylmethyluridine; 5-methoxyuridine; 5-methyluridine, 5-methyl-2-thiouridine; 5-methylaminomethyl-2-selenouridine; 5-methylaminomethyl-2-thiouridine; 5-methylaminomethyluridine; 5-Methyldihydrouridine; 5-Oxyacetic acid-Uridine TP; 5-Oxyacetic acid-methyl ester-Uridine TP; N1-methyl-pseudouridine; uridine 5-oxyacetic acid; uridine 5-oxyacetic acid methyl ester; 3-(3-Amino-3-carboxypropyl)-Uridine TP; 5-(iso-Pentenylaminomethyl)-2-thiouridine TP; 5-(iso-Pentenylaminomethyl)-2'-O-methyluridine TP; 5-(iso-Pentenylaminomethyl)uridine TP; 5-propynyl uracil; α-thio-uridine; 1 (aminoalkylamino-carbonylethylenyl)-2(thio)-pseudouracil; 1 (aminoalkylaminocarbonylethylenyl)-2,4-(dithio)pseudouracil; 1 (aminoalkylaminocarbonylethylenyl)-4 (thio)pseudouracil; 1 (aminoalkylaminocarbonylethylenyl)-pseudouracil; 1 (aminocarbonylethylenyl)-2 (thio)-pseudouracil; 1 (aminocarbonylethylenyl)-2,4-(dithio)pseudouracil; 1 (aminocarbonylethylenyl)-4 (thio) pseudouracil; 1 (aminocarbonylethylenyl)-pseudouracil; 1 substituted 2(thio)-pseudouracil; 1 substituted 2,4-(dithio) pseudouracil; 1 substituted 4 (thio)pseudouracil; 1 substituted pseudouracil; 1-(aminoalkylamino-carbonylethylenyl)-2-(thio)-pseudouracil; 1-Methyl-3-(3-amino-3-carboxypropyl) pseudouridine TP; 1-Methyl-3-(3-amino-3-carboxypropyl)pseudo-UTP; 1-Methyl-pseudo-UTP; 2 (thio)pseudouracil; 2' deoxy uridine; 2' fluorouridine; 2-(thio)uracil; 2,4-(dithio)psuedouracil; 2' methyl, 2'amino, 2'azido, 2'fluro-guanosine; 2'-Amino-2'-deoxy-UTP; 2'-Azido-2'-deoxy-UTP; 2'-Azido-deoxyuridine TP; 2'-O-methylpseudouridine; 2' deoxy uridine; 2' fluorouridine; 2'-Deoxy-2'-a-aminouridine TP; 2'-Deoxy-2'-a-azidouridine TP; 2-methylpseudouridine; 3 (3 amino-3 carboxypropyl) uracil; 4 (thio)pseudouracil; 4-(thio)pseudouracil; 4-(thio) uracil; 4-thiouracil; 5 (1,3-diazole-1-alkyl)uracil; 5 (2-aminopropyl)uracil; 5 (aminoalkyl)uracil; 5 (dimethylaminoalkyl)uracil; 5 (guanidiniumalkyl)uracil; 5 (methoxycarbonylmethyl)-2-(thio)uracil; 5 (methoxycarbonyl-methyl)uracil; 5 (methyl) 2 (thio)uracil; 5 (methyl) 2,4 (dithio)uracil; 5 (methyl) 4 (thio)uracil; 5 (methylaminomethyl)-2 (thio)uracil; 5 (methylaminomethyl)-2,4 (dithio) uracil; 5 (methylaminomethyl)-4 (thio)uracil; 5 (propynyl) uracil; 5 (trifluoromethyl)uracil; 5-(2-aminopropyl)uracil; 5-(alkyl)-2-(thio)pseudouracil; 5-(alkyl)-2,4 (dithio) pseudouracil; 5-(alkyl)-4 (thio)pseudouracil; 5-(alkyl) pseudouracil; 5-(alkyl)uracil; 5-(alkynyl)uracil; 5-(allylamino)uracil; 5-(cyanoalkyl)uracil; 5-(dialkylaminoalkyl) uracil; 5-(dimethylaminoalkyl)uracil; 5-(guanidiniumalkyl) uracil; 5-(halo)uracil; 5-(1,3-diazole-1-alkyl)uracil; 5-(methoxy)uracil; 5-(methoxycarbonylmethyl)-2-(thio) uracil; 5-(methoxycarbonyl-methyl)uracil; 5-(methyl) 2(thio)uracil; 5-(methyl) 2,4 (dithio)uracil; 5-(methyl) 4 (thio)uracil; 5-(methyl)-2-(thio)pseudouracil; 5-(methyl)-2,4 (dithio)pseudouracil; 5-(methyl)-4 (thio)pseudouracil; 5-(methyl)pseudouracil; 5-(methylaminomethyl)-2 (thio)uracil; 5-(methylaminomethyl)-2,4(dithio)uracil; 5-(methylaminomethyl)-4-(thio)uracil; 5-(propynyl)uracil; 5-(trifluoromethyl)uracil; 5-aminoallyl-uridine; 5-bromo-uridine; 5-iodo-uridine; 5-uracil; 6 (azo)uracil; 6-(azo)uracil; 6-aza-uridine; allyamino-uracil; aza uracil; deaza uracil; N3 (methyl)uracil; Pseudo-UTP-1-2-ethanoic acid; Pseudouracil; 4-Thio-pseudo-UTP; 1-carboxymethyl-pseudouridine; 1-methyl-1-deaza-pseudouridine; 1-propynyl-uridine; 1-taurinomethyl-1-methyl-uridine; 1-taurinomethyl-4-thio-uridine; 1-taurinomethyl-pseudouridine; 2-methoxy-4-thio-pseudouridine; 2-thio-1-methyl-1-deaza-pseudouridine; 2-thio-1-methyl-pseudouridine; 2-thio-5-aza-uridine; 2-thio-dihydropseudouridine; 2-thio-dihydrouridine; 2-thio-pseudouridine; 4-methoxy-2-thio-pseudouridine; 4-methoxy-pseudouridine; 4-thio-1-methyl-pseudouridine; 4-thio-pseudouridine; 5-aza-uridine; Dihydropseudouridine; (±)1-(2-Hydroxypropyl)pseudouridine TP; (2R)-1-(2-Hydroxypropyl)pseudouridine TP; (2S)-1-(2-Hydroxypropyl) pseudouridine TP; (E)-5-(2-Bromo-vinyl)ara-uridine TP; (E)-5-(2-Bromo-vinyl)uridine TP; (Z)-5-(2-Bromo-vinyl) ara-uridine TP; (Z)-5-(2-Bromo-vinyl)uridine TP; 1-(2,2,2-Trifluoroethyl)-pseudo-UTP; 1-(2,2,3,3,3-Pentafluoropropyl)pseudouridine TP; 1-(2,2-Diethoxyethyl)pseudouridine TP; 1-(2,4,6-Trimethylbenzyl)pseudouridine TP; 1-(2,4,6-

Trimethyl-benzyl)pseudo-UTP; 1-(2,4,6-Trimethyl-phenyl) pseudo-UTP; 1-(2-Amino-2-carboxyethyl)pseudo-UTP; 1-(2-Amino-ethyl)pseudo-UTP; 1-(2-Hydroxyethyl) pseudouridine TP; 1-(2-Methoxyethyl)pseudouridine TP; 1-(3,4-Bis-trifluoromethoxybenzyl)pseudouridine TP; 1-(3,4-Dimethoxybenzyl)pseudouridine TP; 1-(3-Amino-3-carboxypropyl)pseudo-UTP; 1-(3-Amino-propyl)pseudo-UTP; 1-(3-Cyclopropyl-prop-2-ynyl)pseudouridine TP; 1-(4-Amino-4-carboxybutyl)pseudo-UTP; 1-(4-Amino-benzyl) pseudo-UTP; 1-(4-Amino-butyl)pseudo-UTP; 1-(4-Amino-phenyl)pseudo-UTP; 1-(4-Azidobenzyl)pseudouridine TP; 1-(4-Bromobenzyl)pseudouridine TP; 1-(4-Chlorobenzyl) pseudouridine TP; 1-(4-Fluorobenzyl)pseudouridine TP; 1-(4-Iodobenzyl)pseudouridine TP; 1-(4-Methanesulfonyl-benzyl)pseudouridine TP; 1-(4-Methoxybenzyl)pseudouridine TP; 1-(4-Methoxy-benzyl)pseudo-UTP; 1-(4-Methoxy-phenyl)pseudo-UTP; 1-(4-Methylbenzyl)pseudouridine TP; 1-(4-Methyl-benzyl)pseudo-UTP; 1-(4-Nitrobenzyl) pseudouridine TP; 1-(4-Nitro-benzyl)pseudo-UTP; 1(4-Nitro-phenyl)pseudo-UTP; 1-(4-Thiomethoxybenzyl) pseudouridine TP; 1-(4-Trifluoromethoxybenzyl) pseudouridine TP; 1-(4-Trifluoromethylbenzyl) pseudouridine TP; 1-(5-Amino-pentyl)pseudo-UTP; 1-(6-Amino-hexyl)pseudo-UTP; 1,6-Dimethyl-pseudo-UTP; 1-[3-(2-{2-[2-(2-Aminoethoxy)-ethoxy]-ethoxy}-ethoxy)-propionyl]pseudouridine TP; 1-{3-[2-(2-Aminoethoxy)-ethoxy]-propionyl} pseudouridine TP; 1-Acetylpseudouridine TP; 1-Alkyl-6-(1-propynyl)-pseudo-UTP; 1-Alkyl-6-(2-propynyl)-pseudo-UTP; 1-Alkyl-6-allyl-pseudo-UTP; 1-Alkyl-6-ethynyl-pseudo-UTP; 1-Alkyl-6-homoallyl-pseudo-UTP; 1-Alkyl-6-vinyl-pseudo-UTP; 1-Allylpseudouridine TP; 1-Aminomethyl-pseudo-UTP; 1-Benzoylpseudouridine TP; 1-Benzyloxymethylpseudouridine TP; 1-Benzyl-pseudo-UTP; 1-Biotinyl-PEG2-pseudouridine TP; 1-Biotinylpseudouridine TP; 1-Butyl-pseudo-UTP; 1-Cyanomethylpseudouridine TP; 1-Cyclobutylmethyl-pseudo-UTP; 1-Cyclobutyl-pseudo-UTP; 1-Cycloheptylmethyl-pseudo-UTP; 1-Cycloheptyl-pseudo-UTP; 1-Cyclohexylmethyl-pseudo-UTP; 1-Cyclohexyl-pseudo-UTP; 1-Cyclooctylmethyl-pseudo-UTP; 1-Cyclooctyl-pseudo-UTP; 1-Cyclopentylmethyl-pseudo-UTP; 1-Cyclopentyl-pseudo-UTP; 1-Cyclopropylmethyl-pseudo-UTP; 1-Cyclopropyl-pseudo-UTP; 1-Ethyl-pseudo-UTP; 1-Hexyl-pseudo-UTP; 1-Homoallylpseudouridine TP; 1-Hydroxymethylpseudouridine TP; 1-iso-propyl-pseudo-UTP; 1-Me-2-thio-pseudo-UTP; 1-Me-4-thio-pseudo-UTP; 1-Me-alpha-thio-pseudo-UTP; 1-Methanesulfonylmethylpseudouridine TP; 1-Methoxymethylpseudouridine TP; 1-Methyl-6-(2,2,2-Trifluoroethyl)pseudo-UTP; 1-Methyl-6-(4-morpholino)-pseudo-UTP; 1-Methyl-6-(4-thiomorpholino)-pseudo-UTP; 1-Methyl-6-(substituted phenyl) pseudo-UTP; 1-Methyl-6-amino-pseudo-UTP; 1-Methyl-6-azido-pseudo-UTP; 1-Methyl-6-bromo-pseudo-UTP; 1-Methyl-6-butyl-pseudo-UTP; 1-Methyl-6-chloro-pseudo-UTP; 1-Methyl-6-cyano-pseudo-UTP; 1-Methyl-6-dimethylamino-pseudo-UTP; 1-Methyl-6-ethoxy-pseudo-UTP; 1-Methyl-6-ethylcarboxylate-pseudo-UTP; 1-Methyl-6-ethyl-pseudo-UTP; 1-Methyl-6-fluoro-pseudo-UTP; 1-Methyl-6-formyl-pseudo-UTP; 1-Methyl-6-hydroxyamino-pseudo-UTP; 1-Methyl-6-hydroxy-pseudo-UTP; 1-Methyl-6-iodo-pseudo-UTP; 1-Methyl-6-iso-propyl-pseudo-UTP; 1-Methyl-6-methoxy-pseudo-UTP; 1-Methyl-6-methylamino-pseudo-UTP; 1-Methyl-6-phenyl-pseudo-UTP; 1-Methyl-6-propyl-pseudo-UTP; 1-Methyl-6-tert-butyl-pseudo-UTP; 1-Methyl-6-trifluoromethoxy-pseudo-UTP; 1-Methyl-6-trifluoromethyl-pseudo-UTP; 1-Morpholinomethylpseudouridine TP; 1-Pentyl-pseudo-UTP; 1-Phenyl-pseudo-UTP; 1-Pivaloylpseudouridine TP; 1-Propargylpseudouridine TP; 1-Propyl-pseudo-UTP; 1-propynyl-pseudouridine; 1-p-tolyl-pseudo-UTP; 1-tert-Butyl-pseudo-UTP; 1-Thiomethoxymethylpseudouridine TP; 1-Thiomorpholinomethylpseudouridine TP; 1-Trifluoroacetylpseudouridine TP; 1-Trifluoromethyl-pseudo-UTP; 1-Vinylpseudouridine TP; 2,2'-anhydro-uridine TP; 2'-bromo-deoxyuridine TP; 2'-F-5-Methyl-2'-deoxy-UTP; 2'-OMe-5-Me-UTP; 2'-OMe-pseudo-UTP; 2'-a-Ethynyluridine TP; 2'-a-Trifluoromethyluridine TP; 2'-b-Ethynyluridine TP; 2'-b-Trifluoromethyluridine TP; 2'-Deoxy-2',2'-difluorouridine TP; 2'-Deoxy-2'-a-mercaptouridine TP; 2'-Deoxy-2'-a-thiomethoxyuridine TP; 2'-Deoxy-2'-b-aminouridine TP; 2'-Deoxy-2'-b-azidouridine TP; 2'-Deoxy-2'-b-bromouridine TP; 2'-Deoxy-2'-b-chlorouridine TP; 2'-Deoxy-2'-b-fluorouridine TP; 2'-Deoxy-2'-b-iodouridine TP; 2'-Deoxy-2'-b-mercaptouridine TP; 2'-Deoxy-2'-b-thiomethoxyuridine TP; 2-methoxy-4-thio-uridine; 2-methoxyuridine; 2'-O-Methyl-5-(1-propynyl)uridine TP; 3-Alkyl-pseudo-UTP; 4'-Azidouridine TP; 4'-Carbocyclic uridine TP; 4'-Ethynyluridine TP; 5-(1-Propynyl)ara-uridine TP; 5-(2-Furanyl)uridine TP; 5-Cyanouridine TP; 5-Dimethylaminouridine TP; 5'-Homo-uridine TP; 5-iodo-2'-fluoro-deoxyuridine TP; 5-Phenylethynyluridine TP; 5-Trideuteromethyl-6-deuterouridine TP; 5-Trifluoromethyl-Uridine TP; 5-Vinylarauridine TP; 6-(2,2,2-Trifluoroethyl)-pseudo-UTP; 6-(4-Morpholino)-pseudo-UTP; 6-(4-Thiomorpholino)-pseudo-UTP; 6-(Substituted-Phenyl)-pseudo-UTP; 6-Amino-pseudo-UTP; 6-Azido-pseudo-UTP; 6-Bromo-pseudo-UTP; 6-Butyl-pseudo-UTP; 6-Chloro-pseudo-UTP; 6-Cyano-pseudo-UTP; 6-Dimethylamino-pseudo-UTP; 6-Ethoxy-pseudo-UTP; 6-Ethylcarboxylate-pseudo-UTP; 6-Ethyl-pseudo-UTP; 6-Fluoro-pseudo-UTP; 6-Formyl-pseudo-UTP; 6-Hydroxyamino-pseudo-UTP; 6-Hydroxy-pseudo-UTP; 6-Iodo-pseudo-UTP; 6-iso-Propyl-pseudo-UTP; 6-Methoxy-pseudo-UTP; 6-Methylamino-pseudo-UTP; 6-Methyl-pseudo-UTP; 6-Phenyl-pseudo-UTP; 6-Phenyl-pseudo-UTP; 6-Propyl-pseudo-UTP; 6-tert-Butyl-pseudo-UTP; 6-Trifluoromethoxy-pseudo-UTP; 6-Trifluoromethyl-pseudo-UTP; Alpha-thio-pseudo-UTP; Pseudouridine 1-(4-methylbenzenesulfonic acid) TP; Pseudouridine 1-(4-methylbenzoic acid) TP; Pseudouridine TP 1-[3-(2-ethoxy)]propionic acid; Pseudouridine TP 1-[3-{2-(2-[2-(2-ethoxy)-ethoxy]-ethoxy)-ethoxy}]propionic acid; Pseudouridine TP 1-[3-{2-(2-[2-{2(2-ethoxy)-ethoxy}-ethoxy]-ethoxy)-ethoxy}]-propionic acid; Pseudouridine TP 1-[3-{2-(2-[2-ethoxy]-ethoxy)-ethoxy}]-propionic acid; Pseudouridine TP 1-[3-{2-(2-(2-ethoxy)-ethoxy}] propionic acid; Pseudouridine TP 1-methylphosphonic acid; Pseudouridine TP 1-methylphosphonic acid diethyl ester; Pseudo-UTP-N1-3-propionic acid; Pseudo-UTP-N1-4-butanoic acid; Pseudo-UTP-N1-5-pentanoic acid; Pseudo-UTP-N1-6-hexanoic acid; Pseudo-UTP-N1-7-heptanoic acid; Pseudo-UTP-N1-methyl-p-benzoic acid; Pseudo-UTP-N1-p-benzoic acid; Wybutosine; Hydroxywybutosine; Isowyosine; Peroxywybutosine; undermodified hydroxywybutosine; 4-demethylwyosine; 2,6-(diamino)purine;1-(aza)-2-(thio)-3-(aza)-phenoxazin-1-yl: 1,3-(diaza)-2-(oxo)-phenthiazin-1-yl;1,3-(diaza)-2-(oxo)-phenoxazin-1-yl;1,3,5-(triaza)-2,6-(dioxa)-naphthalene;2 (amino)purine;2,4,5-(trimethyl)phenyl;2' methyl, 2'amino, 2'azido, 2'fluro-cytidine;2' methyl, 2'amino, 2'azido, 2'fluro-adenine;2'methyl, 2'amino, 2'azido, 2'fluro-uridine;2'-amino-2'-deoxyribose; 2-amino-6-Chloro-purine; 2-aza-inosinyl; 2'-azido-2'-deoxyribose; 2'fluoro-2'-deoxyribose; 2'-fluoro-modified bases; 2'-O-methyl-ribose; 2-oxo-7-aminopyridopyrimidin-3-yl; 2-oxo-pyridopyrimidine-3- yl; 2-pyridinone; 3 nitropyrrole; 3-(methyl)-7-(propynyl) isocarbostyrilyl; 3-(methyl)isocarbostyrilyl; 4-(fluoro)-6-(methyl)benzimidazole; 4-(methyl)benzimidazole; 4-(methyl)indolyl; 4,6-(dimethyl)indolyl; 5 nitroindole; 5 substituted pyrimidines; 5-(methyl)isocarbostyrilyl; 5-nitroindole; 6-(aza)pyrimidine; 6-(azo)thymine; 6-(methyl)-7-(aza)indolyl; 6-chloro-purine; 6-phenyl-pyrrolo-pyrimidin-2-on-3-yl; 7-(aminoalkylhydroxy)-1-(aza)-2-(thio)-3-(aza)-phenthiazin-1-yl; 7-(aminoalkylhydroxy)-1-(aza)-2-(thio)-3-(aza)-phenoxazin-1-yl; 7-(aminoalkylhydroxy)-1,3-(diaza)-2-(oxo)-phenoxazin-1-yl; 7-(aminoalkylhydroxy)-1,3-(diaza)-2-(oxo)-phenthiazin-1-yl; 7-(aminoalkylhydroxy)-1,3-(diaza)-2-(oxo)-phenoxazin-1-yl; 7-(aza)indolyl; 7-(guanidiniumalkylhydroxy)-1-(aza)-2-(thio)-3-(aza)-phenoxazinl-yl; 7-(guanidiniumalkylhydroxy)-1-(aza)-2-(thio)-3-(aza)-phenthiazin-1-yl; 7-(guanidiniumalkylhydroxy)-1-(aza)-2-(thio)-3-(aza)-phenoxazin-1-yl; 7-(guanidiniumalkylhydroxy)-1,3-(diaza)-2-(oxo)-phenoxazin-1-yl; 7-(guanidiniumalkyl-hydroxy)-1,3-(diaza)-2-(oxo)-phenthiazin-1-yl; 7-(guanidiniumalkylhydroxy)-1,3-(diaza)-2-(oxo)-phenoxazin-1-yl; 7-(propynyl)isocarbostyrilyl; 7-(propynyl)isocarbostyrilyl, propynyl-7-(aza)indolyl; 7-deaza-inosinyl; 7-substituted 1-(aza)-2-(thio)-3-(aza)-phenoxazin-1-yl; 7-substituted 1,3-(diaza)-2-(oxo)-phenoxazin-1-yl; 9-(methyl)-imidizopyridinyl; Aminoindolyl; Anthracenyl; bis-ortho-(aminoalkylhydroxy)-6-phenyl-pyrrolo-pyrimidin-2-on-3-yl; bis-ortho-substituted-6-phenyl-pyrrolo-pyrimidin-2-on-3-yl; Difluorotolyl; Hypoxanthine; Imidizopyridinyl; Inosinyl; Isocarbostyrilyl; Isoguanisine; N2-substituted purines; N6-methyl-2-amino-purine; N6-substituted purines; N-alkylated derivative; Napthalenyl; Nitrobenzimidazolyl; Nitroimidazolyl; Nitroindazolyl; Nitropyrazolyl; Nubularine; O6-substituted purines; O-alkylated derivative; ortho-(aminoalkylhydroxy)-6-phenyl-pyrrolo-pyrimidin-2-on-3-yl; ortho-substituted-6-phenyl-pyrrolo-pyrimidin-2-on-3-yl; Oxoformycin TP; para-(aminoalkylhydroxy)-6-phenyl-pyrrolo-pyrimidin-2-on-3-yl; para-substituted-6-phenyl-pyrrolo-pyrimidin-2-on-3-yl; Pentacenyl; Phenanthracenyl; Phenyl; propynyl-7-(aza)indolyl; Pyrenyl; pyridopyrimidin-3-yl; pyridopyrimidin-3-yl, 2-oxo-7-amino-pyridopyrimidin-3-yl; pyrrolo-pyrimidin-2-on-3-yl; Pyrrolopyrimidinyl; Pyrrolopyrizinyl; Stilbenzyl; substituted 1,2,4-triazoles; Tetracenyl; Tubercidine; Xanthine; Xanthosine-5'-TP; 2-thio-zebularine; 5-aza-2-thio-zebularine; 7-deaza-2-amino-purine; pyridin-4-one ribonucleoside; 2-Amino-riboside-TP; Formycin A TP; Formycin B TP; Pyrrolosine TP; 2'-OH-ara-adenosine TP; 2'-OH-ara-cytidine TP; 2'-OH-ara-uridine TP; 2'-OH-ara-guanosine TP; 5-(2-carbomethoxyvinyl)uridine TP; and N6-(19-Amino-pentaoxanonadecyl)adenosine TP.

In some embodiments, the polynucleotide (e.g., RNA polynucleotide, such as mRNA polynucleotide) includes a combination of at least two (e.g., 2, 3, 4 or more) of the aforementioned modified nucleobases.

In some embodiments, modified nucleobases in the polynucleotide (e.g., RNA polynucleotide, such as mRNA polynucleotide) are selected from the group consisting of pseudouridine (ψ), N1-methylpseudouridine (m1ψ), 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine5-methyluridine, and 2'-O-methyl uridine. In some embodiments, the polynucleotide (e.g., RNA polynucleotide, such as mRNA polynucleotide) includes a combination of at least two (e.g., 2, 3, 4 or more) of the aforementioned modified nucleobases.

In some embodiments, modified nucleobases in the polynucleotide (e.g., RNA polynucleotide, such as mRNA polynucleotide) are selected from the group consisting of 1-methyl-pseudouridine (m1ψ), 5-methoxy-uridine (mo5U), 5-methyl-cytidine (m5C), pseudouridine (ψ), α-thio-guanosine and α-thio-adenosine. In some embodiments, the polynucleotide includes a combination of at least two (e.g., 2, 3, 4 or more) of the aforementioned modified nucleobases.

In some embodiments, the polynucleotide (e.g., RNA polynucleotide, such as mRNA polynucleotide) comprises pseudouridine (ψ) and 5-methyl-cytidine (m5C). In some embodiments, the polynucleotide (e.g., RNA polynucleotide, such as mRNA polynucleotide) comprises 1-methyl-pseudouridine (m1ψ). In some embodiments, the polynucleotide (e.g., RNA polynucleotide, such as mRNA polynucleotide) comprises 1-methyl-pseudouridine (m1ψ) and 5-methyl-cytidine (m5C). In some embodiments, the polynucleotide (e.g., RNA polynucleotide, such as mRNA polynucleotide) comprises 2-thiouridine (s2U). In some embodiments, the polynucleotide (e.g., RNA polynucleotide, such as mRNA polynucleotide) comprises 2-thiouridine and 5-methyl-cytidine (m5C). In some embodiments, the polynucleotide (e.g., RNA polynucleotide, such as mRNA polynucleotide) comprises methoxy-uridine (mo5U). In some embodiments, the polynucleotide (e.g., RNA polynucleotide, such as mRNA polynucleotide) comprises 5-methoxy-uridine (mo5U) and 5-methyl-cytidine (m5C). In some embodiments, the polynucleotide (e.g., RNA polynucleotide, such as mRNA polynucleotide) comprises 2'-O-methyl uridine. In some embodiments, the polynucleotide (e.g., RNA polynucleotide, such as mRNA polynucleotide) comprises 2'-O-methyl uridine and 5-methyl-cytidine (m5C). In some embodiments, the polynucleotide (e.g., RNA polynucleotide, such as mRNA polynucleotide) comprises N6-methyl-adenosine (m6A). In some embodiments, the polynucleotide (e.g., RNA polynucleotide, such as mRNA polynucleotide) comprises N6-methyl-adenosine (m6A) and 5-methyl-cytidine (m5C).

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 5-methyl-cytidine (m5C), meaning that all cytosine residues in the mRNA sequence are replaced with 5-methyl-cytidine (m5C). Similarly, a polynucleotide can be uniformly modified for any type of nucleoside residue present in the sequence by replacement with a modified residue such as any of those set forth above.

In some embodiments, the modified nucleobase is a modified cytosine. Examples of nucleobases and nucleosides having a modified cytosine include N4-acetyl-cytidine (ac4C), 5-methyl-cytidine (m5C), 5-halo-cytidine (e.g., 5-iodo-cytidine), 5-hydroxymethyl-cytidine (hm5C), 1-methyl-pseudoisocytidine, 2-thio-cytidine (s2C), 2-thio-5-methyl-cytidine.

In some embodiments, a modified nucleobase is a modified uridine. Example nucleobases and nucleosides having a modified uridine include 5-cyano uridine or 4'-thio uridine.

In some embodiments, a modified nucleobase is a modified adenine. Example nucleobases and nucleosides having a modified adenine include 7-deaza-adenine, 1-methyl-adenosine (m1A), 2-methyl-adenine (m2A), N6-methyl-adenosine (m6A), and 2,6-Diaminopurine.

In some embodiments, a modified nucleobase is a modified guanine. Example nucleobases and nucleosides having a modified guanine include inosine (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine.

In some embodiments, the modified nucleobase is a modified uracil. Exemplary nucleobases and nucleosides having a modified uracil include pseudouridine (ψ), pyridin-4-one ribonucleoside, 5-aza-uridine, 6-aza-uridine, 2-thio-5-aza-uridine, 2-thio-uridine ($s^2U$), 4-thio-uridine ($s^4U$), 4-thio-pseudouridine, 2-thio-pseudouridine, 5-hydroxy-uridine ($ho^5U$), 5-aminoallyl-uridine, 5-halo-uridine (e.g., 5-iodo-uridineor 5-bromo-uridine), 3-methyl-uridine ($m^3U$), 5-methoxy-uridine ($mo^5U$), uridine 5-oxyacetic acid ($cmo^5U$), uridine 5-oxyacetic acid methyl ester ($mcmo^5U$), 5-carboxymethyl-uridine ($cm^5U$), 1-carboxymethyl-pseudouridine, 5-carboxyhydroxymethyl-uridine ($chm^5U$), 5-carboxyhydroxymethyl-uridine methyl ester ($mchm^5U$), 5-methoxycarbonylmethyl-uridine ($mcm^5U$), 5-methoxy-carbonylmethyl-2-thio-uridine ($mcm^5s^2U$), 5-aminomethyl-2-thio-uridine ($nm^5s^2U$), 5-methylaminomethyl-uridine ($mnm^5U$), 5-methylaminomethyl-2-thio-uridine ($mnm^5s^2U$), 5-methylaminomethyl-2-seleno-uridine ($mnm^5se^2U$), 5-carbamoylmethyl-uridine ($ncm^5U$), 5-carboxymethylaminomethyl-uridine ($cmnm^5U$), 5-carboxymethylaminomethyl-2-thio-uridine ($cmnm^5s^2U$), 5-propynyl-uridine, 1-propynyl-pseudouridine, 5-taurinomethyl-uridine ($\tau m^5U$), 1-taurinomethyl-pseudouridine, 5-taurinomethyl-2-thio-uridine($\tau m^5s^2U$), 1-taurinomethyl-4-thio-pseudouridine, 5-methyl-uridine ($m^5U$, i.e., having the nucleobase deoxythymine), 1-methyl-pseudouridine ($m^1\psi$), 5-methyl-2-thio-uridine ($m^5s^2U$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine ($m^5D$), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine ($acp^3\psi$), 1-methyl-3-(3-amino-3-carboxypropyl)pseudouridine ($acp^3$ ψ), 5-(isopentenylaminomethyl)uridine ($inm^5U$), 5-(isopentenylaminomethyl)-2-thio-uridine ($inm^5s^2U$), α-thio-uridine, 2'-O-methyl-uridine (Um), 5,2'-O-dimethyl-uridine ($m^5Um$), 2'-O-methyl-pseudouridine (ψm), 2-thio-2'-O-methyl-uridine ($s^2Um$), 5-methoxycarbonylmethyl-2'-O-methyl-uridine ($mcm^5Um$), 5-carbamoylmethyl-2'-O-methyl-uridine ($ncm^5Um$), 5-carboxymethylaminomethyl-2'-O-methyl-uridine ($cmnm^5Um$), 3,2'-O-dimethyl-uridine ($m^3Um$), and 5-(isopentenylaminomethyl)-2'-O-methyl-uridine ($inm^5Um$), 1-thio-uridine, deoxythymidine, 2'-F-ara-uridine, 2'-F-uridine, 2'-OH-ara-uridine, 5-(2-carbomethoxyvinyl) uridine, and 5-[3-(1-E-propenylamino)] uridine.

In some embodiments, the modified nucleobase is a modified cytosine. Exemplary nucleobases and nucleosides having a modified cytosine include 5-aza-cytidine, 6-aza-cytidine, pseudoisocytidine, 3-methyl-cytidine ($m^3C$), N4-acetyl-cytidine ($ac^4C$), 5-formylcytidine ($f^5C$), N4-methyl-cytidine ($m^4C$), 5-methyl-cytidine ($m^5C$), 5-halo-cytidine (e.g., 5-iodo-cytidine), 5-hydroxymethyl-cytidine ($hm^5C$), 1-methyl-pseudoisocytidine, pyrrolo-cytidine, pyrrolo-pseudoisocytidine, 2-thio-cytidine ($s^2C$), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k2C), α-thio-cytidine, 2'-O-methyl-cytidine (Cm), 5,2'-O-dimethyl-cytidine ($m^5Cm$), N4-acetyl-2'-O-methyl-cytidine ($ac^4Cm$), N4,2'-O-dimethyl-cytidine ($m^4Cm$), 5-formyl-2'-O-methyl-cytidine ($f^5Cm$), N4,N4,2'-O-trimethyl-cytidine ($m^42Cm$), 1-thio-cytidine, 2'-F-ara-cytidine, 2'-F-cytidine, and 2'-OH-ara-cytidine.

In some embodiments, the modified nucleobase is a modified adenine. Exemplary nucleobases and nucleosides having a modified adenine include 2-amino-purine, 2, 6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine ($m^1A$), 2-methyl-adenine ($m^2A$), N6-methyl-adenosine ($m^6A$), 2-methylthio-N6-methyl-adenosine ($ms^2m^6A$), N6-isopentenyl-adenosine ($i^6A$), 2-methylthio-N6-isopentenyl-adenosine ($ms^2i^6A$), N6-(cis-hydroxyisopentenyl)adenosine ($io^6A$), 2-methylthio-N6-(cis-hydroxyisopentenyl) adenosine ($ms^2io^6A$), N6-glycinylcarbamoyl-adenosine ($g^6A$), N6-threonylcarbamoyl-adenosine ($t^6A$), N6-methyl-N6-threonylcarbamoyl-adenosine ($m^6t^6A$), 2-methylthio-N6-threonylcarbamoyl-adenosine ($ms^2g^6A$), N6,N6-dimethyl-adenosine ($m^62A$), N6-hydroxynorvalylcarbamoyl-adenosine ($hn^6A$), 2-methylthio-N6-hydroxynorvalylcarbamoyl-adenosine ($ms^2hn^6A$), N6-acetyl-adenosine ($ac^6A$), 7-methyl-adenine, 2-methylthio-adenine, 2-methoxy-adenine, α-thio-adenosine, 2'-O-methyl-adenosine (Am), N6,2'-O-dimethyl-adenosine ($m^6Am$), N6,N6,2'-O-trimethyl-adenosine ($m^62Am$), 1,2'-O-dimethyl-adenosine ($m^1Am$), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

In some embodiments, the modified nucleobase is a modified guanine. Exemplary nucleobases and nucleosides having a modified guanine include inosine (I), 1-methyl-inosine ($m^1I$), wyosine (imG), methylwyosine (mimG), 4-demethyl-wyosine (imG-14), isowyosine (imG2), wybutosine (yW), peroxywybutosine ($o_2yW$), hydroxywybutosine (OhyW), undermodified hydroxywybutosine (OhyW*), 7-deaza-guanosine, queuosine (Q), epoxyqueuosine (oQ), galactosyl-queuosine (galQ), mannosyl-queuosine (manQ), 7-cyano-7-deaza-guanosine ($preQ_0$), 7-aminomethyl-7-deaza-guanosine ($preQ_1$), archaeosine ($G^+$), 7-deaza-8-aza-guanosine, 6-thio-guanosine, 6-thio-7-deaza-guanosine, 6-thio-7-deaza-8-aza-guanosine, 7-methyl-guanosine ($m^7G$), 6-thio-7-methyl-guanosine, 7-methyl-inosine, 6-methoxy-guanosine, 1-methyl-guanosine ($m^1G$), N2-methyl-guanosine ($m^2G$), N2,N2-dimethyl-guanosine ($m^2{}_2G$), N2,7-dimethyl-guanosine ($m^{2,7}G$), N2, N2,7-dimethyl-guanosine ($m^{2,2,7}G$), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2 '-O-methyl-guanosine (Gm), N2-methyl-2'-O-methyl-guanosine ($m^2Gm$), N2,N2-dimethyl-2 '-O-methyl-guanosine ($m^2{}_2Gm$), 1-methyl-2'-O-methyl-guanosine ($m^1Gm$), N2,7-dimethyl-2'-O-methyl-guanosine ($m^{2,7}Gm$), 2 '-O-methyl-inosine (Im), 1,2'-O-dimethyl-inosine ($m^1$Im), 2 '-O-ribosylguanosine (phosphate) (Gr(p)), 1-thio-guanosine, O6-methyl-guanosine, 2'-F-ara-guanosine, and 2'-F-guanosine.

Methods of Treatment

Provided herein are compositions (e.g., pharmaceutical compositions), methods, kits and reagents for prevention and/or treatment of CHIKV, DENV, ZIKV, CHIKV/DENV (the combination of CHIKV and DENV, CHIKV/ZIKV (the combination of CHIKV and ZIKV), ZIKV and DENV (the combination of ZIKV and DENV), and CHIKV/DENV/ZIKV (the combination of CHIKV, DENV and ZIKV) in humans and other mammals. CHIKV RNA (e.g. mRNA) vaccines, DENV RNA (e.g. mRNA) vaccines, ZIKV RNA (e.g. mRNA) vaccines, CHIKV/DENV RNA (e.g. mRNA) vaccines, CHIKV/ZIKV RNA (e.g. mRNA) vaccines, ZIKV/DENV RNA (e.g. mRNA) vaccines, and CHIKV/DENV/ZIKV RNA (e.g. mRNA) vaccines can be used as therapeutic or prophylactic agents. They may be used in medicine to prevent and/or treat infectious disease. In exemplary aspects, the vaccines, of the present disclosure are used to provide prophylactic protection from CHIKV, DENV, ZIKV or any combination of two or three of the foregoing viruses. Prophylactic protection from CHIKV, DENV and/or ZIKV can be achieved following administration of a CHIKV, DENV and/or ZIKV vaccine or combination vaccine, of the present disclosure. Vaccines (including combination vaccines) can be administered once, twice, three times, four times or more but it is likely sufficient to administer the vaccine once (optionally followed by a single booster). It is possible, although less desirable, to administer the vaccine to an infected individual to achieve a therapeutic response. Dosing may need to be adjusted accordingly.

Broad Spectrum Vaccines

It is envisioned that there may be situations where persons are at risk for infection with more than one strain of CHIKV, DENV and/or ZIKV (e.g., more than one strain of CHIKV, more than one strain of DENV, and/or more than one strain of ZIKV). RNA (e.g., mRNA) therapeutic vaccines are particularly amenable to combination vaccination approaches due to a number of factors including, but not limited to, speed of manufacture, ability to rapidly tailor vaccines to accommodate perceived geographical threat, and the like. Moreover, because the vaccines utilize the human body to produce the antigenic protein, the vaccines are amenable to the production of larger, more complex antigenic proteins, allowing for proper folding, surface expression, antigen presentation, etc. in the human subject. To protect against more than one strain of CHIKV, DENV and/or ZIKV, a vaccine (including a combination vaccine) can be administered that includes RNA encoding at least one antigenic polypeptide protein (or antigenic portion thereof) of a first CHIKV, DENV and/or ZIKV and further includes RNA encoding at least one antigenic polypeptide protein (or antigenic portion thereof) of a second CHIKV, DENV and/or ZIKV. RNAs (mRNAs) can be co-formulated, for example, in a single lipid nanoparticle (LNP) or can be formulated in separate LNPs destined for co-administration.

A method of eliciting an immune response in a subject against a CHIKV, DENV and/or ZIKV is provided in aspects of the invention. The method involves administering to the subject a CHIKV, DENV and/or ZIKV RNA vaccine comprising at least one RNA polynucleotide having an open reading frame encoding at least one CHIKV, DENV and/or ZIKV antigenic polypeptide or an immunogenic fragment thereof, thereby inducing in the subject an immune response specific to CHIKV, DENV and/or ZIKV antigenic polypeptide or an immunogenic fragment thereof, wherein anti-antigenic polypeptide antibody titer in the subject is increased following vaccination relative to anti-antigenic polypeptide antibody titer in a subject vaccinated with a prophylactically effective dose of a traditional vaccine against the CHIKV, DENV and/or ZIKV. An "anti-antigenic polypeptide antibody" is a serum antibody the binds specifically to the antigenic polypeptide.

A prophylactically effective dose is a therapeutically effective dose that prevents infection with the virus at a clinically acceptable level. In some embodiments the therapeutically effective dose is a dose listed in a package insert for the vaccine. A traditional vaccine, as used herein, refers to a vaccine other than the mRNA vaccines of the invention. For instance, a traditional vaccine includes but is not limited to live microorganism vaccines, killed microorganism vaccines, subunit vaccines, protein antigen vaccines, DNA vaccines, etc.

In some embodiments the anti-antigenic polypeptide antibody titer in the subject is increased 1 log to 10 log following vaccination relative to anti-antigenic polypeptide antibody titer in a subject vaccinated with a prophylactically effective dose of a traditional vaccine against the CHIKV, DENV and/or ZIKV.

In some embodiments the anti-antigenic polypeptide antibody titer in the subject is increased 1 log following vaccination relative to anti-antigenic polypeptide antibody titer in a subject vaccinated with a prophylactically effective dose of a traditional vaccine against the CHIKV, DENV and/or ZIKV.

In some embodiments the anti-antigenic polypeptide antibody titer in the subject is increased 2 log following vaccination relative to anti-antigenic polypeptide antibody titer in a subject vaccinated with a prophylactically effective dose of a traditional vaccine against the CHIKV, DENV and/or ZIKV.

In some embodiments the anti-antigenic polypeptide antibody titer in the subject is increased 3 log following vaccination relative to anti-antigenic polypeptide antibody titer in a subject vaccinated with a prophylactically effective dose of a traditional vaccine against the CHIKV, DENV and/or ZIKV.

In some embodiments the anti-antigenic polypeptide antibody titer in the subject is increased 5 log following vaccination relative to anti-antigenic polypeptide antibody titer in a subject vaccinated with a prophylactically effective dose of a traditional vaccine against the CHIKV, DENV and/or ZIKV.

In some embodiments the anti-antigenic polypeptide antibody titer in the subject is increased 10 log following vaccination relative to anti-antigenic polypeptide antibody titer in a subject vaccinated with a prophylactically effective dose of a traditional vaccine against the CHIKV, DENV and/or ZIKV.

A method of eliciting an immune response in a subject against a CHIKV, DENV and/or ZIKV is provided in other aspects of the invention. The method involves administering to the subject a CHIKV, DENV and/or ZIKV RNA vaccine comprising at least one RNA polynucleotide having an open reading frame encoding at least one CHIKV, DENV and/or ZIKV antigenic polypeptide or an immunogenic fragment thereof, thereby inducing in the subject an immune response specific to CHIKV, DENV and/or ZIKV antigenic polypeptide or an immunogenic fragment thereof, wherein the immune response in the subject is equivalent to an immune response in a subject vaccinated with a traditional vaccine against the CHIKV, DENV and/or ZIKV at 2 times to 100 times the dosage level relative to the RNA vaccine.

In some embodiments the immune response in the subject is equivalent to an immune response in a subject vaccinated with a traditional vaccine at twice the dosage level relative to the CHIKV, DENV and/or ZIKV RNA vaccine.

In some embodiments the immune response in the subject is equivalent to an immune response in a subject vaccinated with a traditional vaccine at three times the dosage level relative to the CHIKV, DENV and/or ZIKV RNA vaccine.

In some embodiments the immune response in the subject is equivalent to an immune response in a subject vaccinated with a traditional vaccine at 4 times the dosage level relative to the CHIKV, DENV and/or ZIKV vaccine.

In some embodiments the immune response in the subject is equivalent to an immune response in a subject vaccinated with a traditional vaccine at 5 times the dosage level relative to the CHIKV, DENV and/or ZIKV RNA vaccine.

In some embodiments the immune response in the subject is equivalent to an immune response in a subject vaccinated with a traditional vaccine at 10 times the dosage level relative to the CHIKV, DENV and/or ZIKV RNA vaccine.

In some embodiments the immune response in the subject is equivalent to an immune response in a subject vaccinated with a traditional vaccine at 50 times the dosage level relative to the CHIKV, DENV and/or ZIKV RNA vaccine.

In some embodiments the immune response in the subject is equivalent to an immune response in a subject vaccinated with a traditional vaccine at 100 times the dosage level relative to the CHIKV, DENV and/or ZIKV RNA vaccine.

In some embodiments the immune response in the subject is equivalent to an immune response in a subject vaccinated with a traditional vaccine at 10 times to 1000 times the dosage level relative to the CHIKV, DENV and/or ZIKV RNA vaccine.

In some embodiments the immune response in the subject is equivalent to an immune response in a subject vaccinated with a traditional vaccine at 100 times to 1000 times the dosage level relative to the CHIKV, DENV and/or ZIKV RNA vaccine In other embodiments the immune response is assessed by determining [protein] antibody titer in the subject.

In other aspects the present disclosure is a method of eliciting an immune response in a subject against a CHIKV, DENV and/or ZIKV by administering to the subject a CHIKV, DENV and/or ZIKV RNA vaccine comprising at least one RNA polynucleotide having an open reading frame encoding at least one CHIKV, DENV and/or ZIKV antigenic polypeptide or an immunogenic fragment thereof, thereby inducing in the subject an immune response specific to CHIKV, DENV and/or ZIKV antigenic polypeptide or an immunogenic fragment thereof, wherein the immune response in the subject is induced 2 days to 10 weeks earlier relative to an immune response induced in a subject vaccinated with a prophylactically effective dose of a traditional vaccine against the CHIKV, DENV and/or ZIKV. In some embodiments the immune response in the subject is induced in a subject vaccinated with a prophylactically effective dose of a traditional vaccine at 2 times to 100 times the dosage level relative to the RNA vaccine.

In some embodiments the immune response in the subject is induced 2 days earlier relative to an immune response induced in a subject vaccinated with a prophylactically effective dose of a traditional vaccine.

In some embodiments the immune response in the subject is induced 3 days earlier relative to an immune response induced in a subject vaccinated a prophylactically effective dose of a traditional vaccine.

In some embodiments the immune response in the subject is induced 1 week earlier relative to an immune response induced in a subject vaccinated with a prophylactically effective dose of a traditional vaccine.

In some embodiments the immune response in the subject is induced 2 weeks earlier relative to an immune response induced in a subject vaccinated with a prophylactically effective dose of a traditional vaccine.

In some embodiments the immune response in the subject is induced 3 weeks earlier relative to an immune response induced in a subject vaccinated with a prophylactically effective dose of a traditional vaccine.

In some embodiments the immune response in the subject is induced 5 weeks earlier relative to an immune response induced in a subject vaccinated with a prophylactically effective dose of a traditional vaccine.

In some embodiments the immune response in the subject is induced 10 weeks earlier relative to an immune response induced in a subject vaccinated with a prophylactically effective dose of a traditional vaccine.

Also provided herein are methods of eliciting an immune response in a subject against a CHIKV, DENV and/or ZIKV by administering to the subject a CHIKV, DENV and/or ZIKV RNA vaccine having an open reading frame encoding a first antigenic polypeptide, wherein the RNA polynucleotide does not include a stabilization element, and wherein an adjuvant is not coformulated or co-administered with the vaccine.

Therapeutic and Prophylactic Compositions

Provided herein are compositions, methods, kits and reagents for the prevention, treatment or diagnosis of Chikungunya virus in humans and other mammals, for example. The active therapeutic agents of the present disclosure include the CHIKV, DENV and/or ZIKV RNA vaccines, including combination RNA vaccines), cells containing CHIKV, DENV and/or ZIKV RNA vaccines, including combination RNA vaccines), and antigenic polypeptides translated from the polynucleotides comprising the RNA vaccines. CHIKV, DENV and/or ZIKV RNA vaccines, including combination RNA vaccines) can be used as therapeutic or prophylactic agents. They may be used in medicine and/or for the priming of immune effector cells, for example, to activate peripheral blood mononuclear cells (PBMCs) ex vivo, which are then infused (re-infused) into a subject.

In some embodiments, a vaccines, including a combination vaccine, containing RNA polynucleotides, e.g., mRNA, as described herein can be administered to a subject (e.g., a mammalian subject, such as a human subject), and the RNA polynucleotides are translated in vivo to produce an antigenic polypeptide.

The CHIKV, DENV and/or ZIKV RNA vaccines, including combination RNA vaccines, may be induced for translation of a polypeptide (e.g., antigen or immunogen) in a cell, tissue or organism. Such translation can be in vivo, ex vivo, in culture or in vitro. The cell, tissue or organism is contacted with an effective amount of a composition containing a CHIKV, DENV and/or ZIKV RNA vaccines, including combination RNA vaccines, that contains a polynucleotide that has at least one a translatable region encoding an antigenic polypeptide.

An “effective amount” of the CHIKV, DENV and/or ZIKV RNA vaccines, including combination RNA vaccines, is provided based, at least in part, on the target tissue, target cell type, means of administration, physical characteristics of the polynucleotide (e.g., size, and extent of modified nucleosides) and other components of the CHIKV, DENV and/or ZIKV RNA vaccines, including combination RNA vaccines, and other determinants. In general, CHIKV, DENV and/or ZIKV RNA vaccines, including combination RNA vaccines, provides an induced or boosted immune response as a function of antigen production in the cell, preferably more efficient than a composition containing a corresponding unmodified polynucleotide encoding the same antigen or a peptide antigen. Increased antigen production may be demonstrated by increased cell transfection (the percentage of cells transfected with the RNA vaccine), increased protein translation from the polynucleotide, decreased nucleic acid degradation (as demonstrated, for example, by increased duration of protein translation from a modified polynucleotide), or altered antigen specific immune response of the host cell.

In some embodiments, RNA vaccines (including polynucleotides and their encoded polypeptides) and cells comprising the RNA vaccines in accordance with the present disclosure may be used for the treatment of Chikungunya virus, Dengue virus, Zika virus, or any combination of two or three of the foregoing viruses.

CHIKV, DENV and/or ZIKV RNA vaccines, including combination RNA vaccines, may be administered prophylactically or therapeutically as part of an active immunization scheme to healthy individuals or early in infection during the incubation phase or during active infection after onset of symptoms. In some embodiments, the amount of RNA vaccine of the present disclosure provided to a cell, a tissue or a subject may be an amount effective for immune prophylaxis.

CHIKV, DENV and/or ZIKV RNA vaccines, including combination RNA vaccines, may be administered with other prophylactic or therapeutic compounds. As a non-limiting example, a prophylactic or therapeutic compound may be an adjuvant or a booster. As used herein, when referring to a prophylactic composition, such as a vaccine, the term "booster" refers to an extra administration of the prophylactic (vaccine) composition. A booster (or booster vaccine) may be given after an earlier administration of the prophylactic composition. The time of administration between the initial administration of the prophylactic composition and the booster may be, but is not limited to, 1 minute, 2 minutes, 3 minutes, 4 minutes, 5 minutes, 6 minutes, 7 minutes, 8 minutes, 9 minutes, 10 minutes, 15 minutes, 20 minutes 35 minutes, 40 minutes, 45 minutes, 50 minutes, 55 minutes, 1 hour, 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 36 hours, 2 days, 3 days, 4 days, 5 days, 6 days, 1 week, 10 days, 2 weeks, 3 weeks, 1 month, 2 months, 3 months, 4 months, 5 months, 6 months, 7 months, 8 months, 9 months, 10 months, 11 months, 1 year, 15 months, 18 months, 21 months, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, 25 years, 30 years, 35 years, 40 years, 45 years, 50 years, 55 years, 60 years, 65 years, 70 years, 75 years, 80 years, 85 years, 90 years, 95 years or more than 99 years, and any time period in-between.

In some embodiments, CHIKV, DENV and/or ZIKV RNA vaccines, including combination RNA vaccines, may be administered intramuscularly or intradermally, similarly to the administration of inactivated vaccines known in the art.

The CHIKV, DENV and/or ZIKV RNA vaccines, including combination RNA vaccines, may be utilized in various settings depending on the prevalence of the infection or the degree or level of unmet medical need. As a non-limiting example, the RNA vaccines may be utilized to treat and/or prevent infectious disease caused by Chikungunya virus. RNA vaccines have superior properties in that they produce much larger antibody titers and produce responses early than commercially available anti-virals.

Provided herein are pharmaceutical compositions including CHIKV, DENV and/or ZIKV RNA vaccines, including combination RNA vaccines and RNA vaccine compositions and/or complexes optionally in combination with one or more pharmaceutically acceptable excipients.

CHIKV, DENV and/or ZIKV RNA vaccines, including combination RNA vaccines, may be formulated or administered alone or in conjunction with one or more other components. For instance, CHIKV, DENV and/or ZIKV RNA vaccines, including combination RNA vaccines (vaccine compositions) may comprise other components including, but not limited to, adjuvants. In some embodiments, CHIKV, DENV and/or ZIKV RNA vaccines, including combination RNA vaccines, do not include an adjuvant (they are adjuvant free).

CHIKV, DENV and/or ZIKV RNA vaccines, including combination RNA vaccines, may be formulated or administered in combination with one or more pharmaceutically-acceptable excipients. In some embodiments, vaccine compositions comprise at least one additional active substance, such as, for example, a therapeutically-active substance, a prophylactically-active substance, or a combination of both. Vaccine compositions may be sterile, pyrogen-free or both sterile and pyrogen-free. General considerations in the formulation and/or manufacture of pharmaceutical agents, such as vaccine compositions, may be found, for example, in Remington: The Science and Practice of Pharmacy 21st ed., Lippincott Williams & Wilkins, 2005 (incorporated herein by reference in its entirety).

In some embodiments, CHIKV, DENV and/or ZIKV RNA vaccines, including combination RNA vaccines, are administered to humans, human patients or subjects. For the purposes of the present disclosure, the phrase "active ingredient" generally refers to the RNA vaccines or the polynucleotides contained therein, for example, RNA polynucleotides (e.g., mRNA polynucleotides) encoding CHIKV, DENV and/or ZIKV antigenic polypeptides.

Formulations of the vaccine compositions described herein may be prepared by any method known or hereafter developed in the art of pharmacology. In general, such preparatory methods include the step of bringing the active ingredient (e.g., mRNA polynucleotide) into association with an excipient and/or one or more other accessory ingredients, and then, if necessary and/or desirable, dividing, shaping and/or packaging the product into a desired single- or multi-dose unit.

Relative amounts of the active ingredient, the pharmaceutically acceptable excipient, and/or any additional ingredients in a pharmaceutical composition in accordance with the disclosure will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

CHIKV, DENV and/or ZIKV RNA vaccines, including combination RNA vaccines, can be formulated using one or more excipients to: (1) increase stability; (2) increase cell transfection; (3) permit the sustained or delayed release (e.g., from a depot formulation); (4) alter the biodistribution (e.g., target to specific tissues or cell types); (5) increase the translation of encoded protein in vivo; and/or (6) alter the release profile of encoded protein (antigen) in vivo. In addition to traditional excipients such as any and all solvents, dispersion media, diluents, or other liquid vehicles, dispersion or suspension aids, surface active agents, isotonic agents, thickening or emulsifying agents, preservatives, excipients can include, without limitation, lipidoids, liposomes, lipid nanoparticles, polymers, lipoplexes, core-shell nanoparticles, peptides, proteins, cells transfected with CHIKV, DENV and/or ZIKV RNA vaccines, including combination RNA vaccines, (e.g., for transplantation into a subject), hyaluronidase, nanoparticle mimics and combinations thereof.

Stabilizing Elements

Naturally-occurring eukaryotic mRNA molecules have been found to contain stabilizing elements, including, but not limited to untranslated regions (UTR) at their 5'-end (5'UTR) and/or at their 3'-end (3'UTR), in addition to other structural features, such as a 5'-cap structure or a 3'-poly(A) tail. Both the 5'UTR and the 3'UTR are typically transcribed from the genomic DNA and are elements of the premature mRNA. Characteristic structural features of mature mRNA, such as the 5'-cap and the 3'-poly(A) tail are usually added to the transcribed (premature) mRNA during mRNA processing. The 3'-poly(A) tail is typically a stretch of adenine nucleotides added to the 3'-end of the transcribed mRNA. It can comprise up to about 400 adenine nucleotides. In some embodiments the length of the 3'-poly(A) tail may be an essential element with respect to the stability of the individual mRNA.

In some embodiments the RNA vaccine may include one or more stabilizing elements. Stabilizing elements may include for instance a histone stem-loop. A stem-loop binding protein (SLBP), a 32 kDa protein has been identified. It is associated with the histone stem-loop at the 3'-end of the histone messages in both the nucleus and the cytoplasm. Its expression level is regulated by the cell cycle; it is peaks during the S-phase, when histone mRNA levels are also elevated. The protein has been shown to be essential for efficient 3'-end processing of histone pre-mRNA by the U7 snRNP. SLBP continues to be associated with the stem-loop after processing, and then stimulates the translation of mature histone mRNAs into histone proteins in the cytoplasm. The RNA binding domain of SLBP is conserved through metazoa and protozoa; its binding to the histone stem-loop depends on the structure of the loop. The minimum binding site includes at least three nucleotides 5' and two nucleotides 3' relative to the stem-loop.

In some embodiments, the RNA vaccines include a coding region, at least one histone stem-loop, and optionally, a poly(A) sequence or polyadenylation signal. The poly(A) sequence or polyadenylation signal generally should enhance the expression level of the encoded protein. The encoded protein, in some embodiments, is not a histone protein, a reporter protein (e.g. Luciferase, GFP, EGFP, β-Galactosidase, EGFP), or a marker or selection protein (e.g. alpha-Globin, Galactokinase and Xanthine:guanine phosphoribosyl transferase (GPT)).

In some embodiments, the combination of a poly(A) sequence or polyadenylation signal and at least one histone stem-loop, even though both represent alternative mechanisms in nature, acts synergistically to increase the protein expression beyond the level observed with either of the individual elements. It has been found that the synergistic effect of the combination of poly(A) and at least one histone stem-loop does not depend on the order of the elements or the length of the poly(A) sequence.

In some embodiments, the RNA vaccine does not comprise a histone downstream element (HDE). "Histone downstream element" (HDE) includes a purine-rich polynucleotide stretch of approximately 15 to 20 nucleotides 3' of naturally occurring stem-loops, representing the binding site for the U7 snRNA, which is involved in processing of histone pre-mRNA into mature histone mRNA. Ideally, the inventive nucleic acid does not include an intron.

In some embodiments, the RNA vaccine may or may not contain a enhancer and/or promoter sequence, which may be modified or unmodified or which may be activated or inactivated. In some embodiments, the histone stem-loop is generally derived from histone genes, and includes an intramolecular base pairing of two neighbored partially or entirely reverse complementary sequences separated by a spacer, consisting of a short sequence, which forms the loop of the structure. The unpaired loop region is typically unable to base pair with either of the stem loop elements. It occurs more often in RNA, as is a key component of many RNA secondary structures, but may be present in single-stranded DNA as well. Stability of the stem-loop structure generally depends on the length, number of mismatches or bulges, and base composition of the paired region. In some embodiments, wobble base pairing (non-Watson-Crick base pairing) may result. In some embodiments, the at least one histone stem-loop sequence comprises a length of 15 to 45 nucleotides.

In other embodiments the RNA vaccine may have one or more AU-rich sequences removed. These sequences, sometimes referred to as AURES are destabilizing sequences found in the 3'UTR. The AURES may be removed from the RNA vaccines. Alternatively the AURES may remain in the RNA vaccine.

Nanoparticle Formulations

In some embodiments, CHIKV, DENV and/or ZIKV RNA vaccines, including combination RNA vaccines, are formulated in a nanoparticle. In some embodiments, CHIKV, DENV and/or ZIKV RNA vaccines, including combination RNA vaccines, are formulated in a lipid nanoparticle. In some embodiments, CHIKV, DENV and/or ZIKV RNA vaccines, including combination RNA vaccines, are formulated in a lipid-polycation complex, referred to as a cationic lipid nanoparticle. The formation of the lipid nanoparticle may be accomplished by methods known in the art and/or as described in U.S. Pub. No. 20120178702, herein incorporated by reference in its entirety. As a non-limiting example, the cationic lipid nanoparticle may include a cationic peptide or a polypeptide such as, but not limited to, polylysine, polyornithine and/or polyarginine and the cationic peptides described in International Pub. No. WO2012013326 or US Patent Pub. No. US20130142818; each of which is herein incorporated by reference in its entirety. In some embodiments, CHIKV, DENV and/or ZIKV RNA vaccines, including combination RNA vaccines, are formulated in a lipid nanoparticle that includes a non-cationic lipid such as, but not limited to, cholesterol or dioleoyl phosphatidylethanolamine (DOPE).

A lipid nanoparticle formulation may be influenced by, but not limited to, the selection of the cationic lipid component, the degree of cationic lipid saturation, the nature of the PEGylation, ratio of all components and biophysical parameters such as size. For example, the lipid nanoparticle formulation may be composed of 57.1% cationic lipid, 7.1% dipalmitoylphosphatidylcholine, 34.3% cholesterol, and 1.4% PEG-c-DMA. (Semple et al., Nature Biotech. 2010 28:172-176; herein incorporated by reference in its entirety). Altering the composition of the cationic lipid can more effectively deliver RNA to various antigen presenting cells (Basha et al. Mol Ther. 2011 19:2186-2200; herein incorporated by reference in its entirety).

In some embodiments, lipid nanoparticle formulations may comprise 35 to 45% cationic lipid, 40% to 50% cationic lipid, 50% to 60% cationic lipid and/or 55% to 65% cationic lipid. In some embodiments, the ratio of lipid to RNA (e.g., mRNA) in lipid nanoparticles may be 5:1 to 20:1, 10:1 to 25:1, 15:1 to 30:1 and/or at least 30:1.

In some embodiments, the ratio of PEG in the lipid nanoparticle formulations may be increased or decreased and/or the carbon chain length of the PEG lipid may be modified from C14 to C18 to alter the pharmacokinetics and/or biodistribution of the lipid nanoparticle formulations. As a non-limiting example, lipid nanoparticle formulations may contain 0.5% to 3.0%, 1.0% to 3.5%, 1.5% to 4.0%, 2.0% to 4.5%, 2.5% to 5.0% and/or 3.0% to 6.0% of the lipid molar ratio of PEG-c-DOMG (R-3-[(ω-methoxy-poly(ethyleneglycol)2000)carbamoyl)]-1,2-dimyristyloxypropyl-3-amine) (also referred to herein as PEG-DOMG) as compared to the cationic lipid, DSPC and cholesterol. In some embodiments, the PEG-c-DOMG may be replaced with a PEG lipid such as, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In some embodiments, the CHIKV, DENV and/or ZIKV RNA vaccines, including combination RNA vaccine formulation is a nanoparticle that comprises at least one lipid. The lipid may be selected from, but is not limited to, DLin-DMA, Dlin-K-DMA, 98N12-5, C12-200, Dlin-MC3-DMA, Dlin-KC2-DMA, DODMA, PLGA, PEG, PEG-DMG, PEGylated lipids and amino alcohol lipids. In some embodiments, the lipid may be a cationic lipid such as, but not limited to, Dlin-DMA, Dlin-D-DMA, Dlin-MC3-DMA, Dlin-KC2-DMA, DODMA and amino alcohol lipids. The amino alcohol cationic lipid may be the lipids described in and/or made by the methods described in US Patent Publication No. US20130150625, herein incorporated by reference in its entirety. As a non-limiting example, the cationic lipid may be 2-amino-3-[(9Z,12Z)-octadeca-9,12-dien-1-yloxy]-2-{[(9Z,2Z)-octadeca-9,12-dien-1-yloxy]methyl} propan-1-ol (Compound 1 in US20130150625); 2-amino-3-[(9Z)-octadec-9-en-1-yloxy]-2-{[(9Z)-octadec-9-en-1-yloxy]methyl}propan-1-ol (Compound 2 in US20130150625); 2-amino-3-[(9Z,12Z)-octadeca-9,12-dien-1-yloxy]-2-[(octyloxy)methyl]propan-1-ol (Compound 3 in US20130150625); and 2-(dimethylamino)-3-[(9Z,12Z)-octadeca-9,12-dien-1-yloxy]-2-{[(9Z,12Z)-octadeca-9,12-dien-1-yloxy]methyl}propan-1-ol (Compound 4 in US20130150625); or any pharmaceutically acceptable salt or stereoisomer thereof.

Lipid nanoparticle formulations typically comprise a lipid, in particular, an ionizable cationic lipid, for example, 2,2-dilinoleyl-4-dimethylaminoethyl-[1,3]-dioxolane (Dlin-KC2-DMA), dilinoleyl-methyl-4-dimethylaminobutyrate (Dlin-MC3-DMA), or di((Z)-non-2-en-1-yl) 9-((4-(dimethylamino)butanoyl)oxy)heptadecanedioate (L319), and further comprise a neutral lipid, a sterol and a molecule capable of reducing particle aggregation, for example a PEG or PEG-modified lipid.

In some embodiments, a lipid nanoparticle formulation consists essentially of (i) at least one lipid selected from the group consisting of 2,2-dilinoleyl-4-dimethylaminoethyl-[1,3]-dioxolane (Dlin-KC2-DMA), dilinoleyl-methyl-4-dimethylaminobutyrate (Dlin-MC3-DMA), and di((Z)-non-2-en-1-yl) 9-((4-(dimethylamino)butanoyl)oxy)heptadecanedioate (L319); (ii) a neutral lipid selected from DSPC, DPPC, POPC, DOPE and SM; (iii) a sterol, e.g., cholesterol; and (iv) a PEG-lipid, e.g., PEG-DMG or PEG-cDMA, in a molar ratio of 20-60% cationic lipid: 5-25% neutral lipid: 25-55% sterol; 0.5-15% PEG-lipid.

In some embodiments, a lipid nanoparticle formulation includes 25% to 75% on a molar basis of a cationic lipid selected from 2,2-dilinoleyl-4-dimethylaminoethyl-[1,3]-dioxolane (Dlin-KC2-DMA), dilinoleyl-methyl-4-dimethylaminobutyrate (Dlin-MC3-DMA), and di((Z)-non-2-en-1-yl) 9-((4-(dimethylamino)butanoyl)oxy)heptadecanedioate (L319), e.g., 35 to 65%, 45 to 65%, 60%, 57.5%, 50% or 40% on a molar basis.

In some embodiments, a lipid nanoparticle formulation includes 0.5% to 15% on a molar basis of the neutral lipid, e.g., 3 to 12%, 5 to 10% or 15%, 10%, or 7.5% on a molar basis. Examples of neutral lipids include, without limitation, DSPC, POPC, DPPC, DOPE and SM. In some embodiments, the formulation includes 5% to 50% on a molar basis of the sterol (e.g., 15 to 45%, 20 to 40%, 40%, 38.5%, 35%, or 31% on a molar basis. A non-limiting example of a sterol is cholesterol. In some embodiments, a lipid nanoparticle formulation includes 0.5% to 20% on a molar basis of the PEG or PEG-modified lipid (e.g., 0.5 to 10%, 0.5 to 5%, 1.5%, 0.5%, 1.5%, 3.5%, or 5% on a molar basis. In some embodiments, a PEG or PEG modified lipid comprises a PEG molecule of an average molecular weight of 2,000 Da. In some embodiments, a PEG or PEG modified lipid comprises a PEG molecule of an average molecular weight of less than 2,000, for example around 1,500 Da, around 1,000 Da, or around 500 Da. Non-limiting examples of PEG-modified lipids include PEG-distearoyl glycerol (PEG-DMG) (also referred herein as PEG-C14 or C14-PEG), PEG-cDMA (further discussed in Reyes et al. J. Controlled Release, 107, 276-287 (2005) the contents of which are herein incorporated by reference in its entirety).

In some embodiments, lipid nanoparticle formulations include 25-75% of a cationic lipid selected from 2,2-dilinoleyl-4-dimethylaminoethyl-[1,3]-dioxolane (Dlin-KC2-DMA), dilinoleyl-methyl-4-dimethylaminobutyrate (Dlin-MC3-DMA), and di((Z)-non-2-en-1-yl) 9-((4-(dimethylamino)butanoyl)oxy)heptadecanedioate (L319), 0.5-15% of the neutral lipid, 5-50% of the sterol, and 0.5-20% of the PEG or PEG-modified lipid on a molar basis.

In some embodiments, lipid nanoparticle formulations include 35-65% of a cationic lipid selected from 2,2-dilinoleyl-4-dimethylaminoethyl[1,3]-dioxolane (Dlin-KC2-DMA), dilinoleyl-methyl-4-dimethylaminobutyrate (Dlin-MC3-DMA), and di((Z)-non-2-en-1-yl) 9-((4-(dimethylamino)butanoyl)oxy)heptadecanedioate (L319), 3-12% of the neutral lipid, 15-45% of the sterol, and 0.5-10% of the PEG or PEG-modified lipid on a molar basis.

In some embodiments, lipid nanoparticle formulations include 45-65% of a cationic lipid selected from 2,2-dilinoleyl-4-dimethylaminoethyl[1,3]-dioxolane (Dlin-KC2-DMA), dilinoleyl-methyl-4-dimethylaminobutyrate (Dlin-MC3-DMA), and di((Z)-non-2-en-1-yl) 9-((4-(dimethylamino)butanoyl)oxy)heptadecanedioate (L319), 5-10% of the neutral lipid, 25-40% of the sterol, and 0.5-10% of the PEG or PEG-modified lipid on a molar basis.

In some embodiments, lipid nanoparticle formulations include 60% of a cationic lipid selected from 2,2-dilinoleyl-4-dimethylaminoethyl[1,3]-dioxolane (Dlin-KC2-DMA), dilinoleyl-methyl-4-dimethylaminobutyrate (Dlin-MC3-DMA), and di((Z)-non-2-en-1-yl) 9-((4-(dimethylamino)butanoyl)oxy)heptadecanedioate (L319), 7.5% of the neutral lipid, 31% of the sterol, and 1.5% of the PEG or PEG-modified lipid on a molar basis.

In some embodiments, lipid nanoparticle formulations include 50% of a cationic lipid selected from 2,2-dilinoleyl-4-dimethylaminoethyl[1,3]-dioxolane (Dlin-KC2-DMA), dilinoleyl-methyl-4-dimethylaminobutyrate (Dlin-MC3-DMA), and di((Z)-non-2-en-1-yl) 9-((4-(dimethylamino)butanoyl)oxy)heptadecanedioate (L319), 10% of the neutral lipid, 38.5% of the sterol, and 1.5% of the PEG or PEG-modified lipid on a molar basis.

In some embodiments, lipid nanoparticle formulations include 50% of a cationic lipid selected from 2,2-dilinoleyl-4-dimethylaminoethyl[1,3]-dioxolane (Dlin-KC2-DMA), dilinoleyl-methyl-4-dimethylaminobutyrate (Dlin-MC3-DMA), and di((Z)-non-2-en-1-yl) 9-((4-(dimethylamino)butanoyl)oxy)heptadecanedioate (L319), 10% of the neutral lipid, 35% of the sterol, 4.5% or 5% of the PEG or PEG-modified lipid, and 0.5% of the targeting lipid on a molar basis.

In some embodiments, lipid nanoparticle formulations include 40% of a cationic lipid selected from 2,2-dilinoleyl-4-dimethylaminoethyl-[1,3]-dioxolane (Dlin-KC2-DMA), dilinoleyl-methyl-4-dimethylaminobutyrate (Dlin-MC3-DMA), and di((Z)-non-2-en-1-yl) 9-((4-(dimethylamino)butanoyl)oxy)heptadecanedioate (L319), 15% of the neutral lipid, 40% of the sterol, and 5% of the PEG or PEG-modified lipid on a molar basis.

In some embodiments, lipid nanoparticle formulations include 57.2% of a cationic lipid selected from 2,2-dilinoleyl-4-dimethylaminoethyl-[1,3]-dioxolane (Dlin-KC2-DMA), dilinoleyl-methyl-4-dimethylaminobutyrate (Dlin-MC3-DMA), and di((Z)-non-2-en-1-yl) 9-((4-(dimethylamino)butanoyl)oxy)heptadecanedioate (L319), 7.1% of the neutral lipid, 34.3% of the sterol, and 1.4% of the PEG or PEG-modified lipid on a molar basis.

In some embodiments, lipid nanoparticle formulations include 57.5% of a cationic lipid selected from the PEG lipid is PEG-cDMA (PEG-cDMA is further discussed in Reyes et al. (J. Controlled Release, 107, 276-287 (2005), the contents of which are herein incorporated by reference in its entirety), 7.5% of the neutral lipid, 31.5% of the sterol, and 3.5% of the PEG or PEG-modified lipid on a molar basis.

In some embodiments, lipid nanoparticle formulations consists essentially of a lipid mixture in molar ratios of 20-70% cationic lipid: 5-45% neutral lipid: 20-55% cholesterol: 0.5-15% PEG-modified lipid. In some embodiments, lipid nanoparticle formulations consists essentially of a lipid mixture in a molar ratio of 20-60% cationic lipid: 5-25% neutral lipid: 25-55% cholesterol: 0.5-15% PEG-modified lipid.

In some embodiments, the molar lipid ratio is 50/10/38.5/1.5 (mol % cationic lipid/neutral lipid, e.g., DSPC/Chol/PEG-modified lipid, e.g., PEG-DMG, PEG-DSG or PEG-DPG), 57.2/7.1134.3/1.4 (mol % cationic lipid/neutral lipid, e.g., DPPC/Chol/PEG-modified lipid, e.g., PEG-cDMA), 40/15/40/5 (mol % cationic lipid/neutral lipid, e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10 (mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

Non-limiting examples of lipid nanoparticle compositions and methods of making them are described, for example, in Semple et al. (2010) Nat. Biotechnol. 28:172-176; Jayarama et al. (2012), Angew. Chem. Int. Ed., 51: 8529-8533; and Maier et al. (2013) Molecular Therapy 21, 1570-1578 (the contents of each of which are incorporated herein by reference in their entirety).

In some embodiments, lipid nanoparticle formulations may comprise a cationic lipid, a PEG lipid and a structural lipid and optionally comprise a non-cationic lipid. As a non-limiting example, a lipid nanoparticle may comprise 40-60% of cationic lipid, 5-15% of a non-cationic lipid, 1-2% of a PEG lipid and 30-50% of a structural lipid. As another non-limiting example, the lipid nanoparticle may comprise 50% cationic lipid, 10% non-cationic lipid, 1.5% PEG lipid and 38.5% structural lipid. As yet another non-limiting example, a lipid nanoparticle may comprise 55% cationic lipid, 10% non-cationic lipid, 2.5% PEG lipid and 32.5% structural lipid. In some embodiments, the cationic lipid may be any cationic lipid described herein such as, but not limited to, Dlin-KC2-DMA, Dlin-MC3-DMA and L319.

In some embodiments, the lipid nanoparticle formulations described herein may be 4 component lipid nanoparticles. The lipid nanoparticle may comprise a cationic lipid, a non-cationic lipid, a PEG lipid and a structural lipid. As a non-limiting example, the lipid nanoparticle may comprise 40-60% of cationic lipid, 5-15% of a non-cationic lipid, 1-2% of a PEG lipid and 30-50% of a structural lipid. As another non-limiting example, the lipid nanoparticle may comprise 50% cationic lipid, 10% non-cationic lipid, 1.5% PEG lipid and 38.5% structural lipid. As yet another non-limiting example, the lipid nanoparticle may comprise 55% cationic lipid, 10% non-cationic lipid, 2.5% PEG lipid and 32.5% structural lipid. In some embodiments, the cationic lipid may be any cationic lipid described herein such as, but not limited to, Dlin-KC2-DMA, Dlin-MC3-DMA and L319.

In some embodiments, the lipid nanoparticle formulations described herein may comprise a cationic lipid, a non-cationic lipid, a PEG lipid and a structural lipid. As a non-limiting example, the lipid nanoparticle comprise 50% of the cationic lipid Dlin-KC2-DMA, 10% of the non-cationic lipid DSPC, 1.5% of the PEG lipid PEG-DOMG and 38.5% of the structural lipid cholesterol. As a non-limiting example, the lipid nanoparticle comprise 50% of the cationic lipid Dlin-MC3-DMA, 10% of the non-cationic lipid DSPC, 1.5% of the PEG lipid PEG-DOMG and 38.5% of the structural lipid cholesterol. As a non-limiting example, the lipid nanoparticle comprise 50% of the cationic lipid Dlin-MC3-DMA, 10% of the non-cationic lipid DSPC, 1.5% of the PEG lipid PEG-DMG and 38.5% of the structural lipid cholesterol. As yet another non-limiting example, the lipid nanoparticle comprise 55% of the cationic lipid L319, 10% of the non-cationic lipid DSPC, 2.5% of the PEG lipid PEG-DMG and 32.5% of the structural lipid cholesterol.

Relative amounts of the active ingredient, the pharmaceutically acceptable excipient, and/or any additional ingredients in a vaccine composition may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the RNA vaccine composition may comprise the polynucleotide described herein, formulated in a lipid nanoparticle comprising MC3, Cholesterol, DSPC and PEG2000-DMG, the buffer trisodium citrate, sucrose and water for injection. As a non-limiting example, the composition comprises: 2.0 mg/mL of drug substance (e.g., polynucleotides encoding H10N8 influenza virus), 21.8 mg/mL of MC3, 10.1 mg/mL of cholesterol, 5.4 mg/mL of DSPC, 2.7 mg/mL of PEG2000-DMG, 5.16 mg/mL of trisodium citrate, 71 mg/mL of sucrose and 1.0 mL of water for injection.

In some embodiments, a nanoparticle (e.g., a lipid nanoparticle) has a mean diameter of 10-500 nm, 20-400 nm, 30-300 nm, 40-200 nm. In some embodiments, a nanoparticle (e.g., a lipid nanoparticle) has a mean diameter of 50-150 nm, 50-200 nm, 80-100 nm or 80-200 nm.

In one embodiment, the RNA vaccines of the invention may be formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In one embodiment, the lipid nanoparticles may have a diameter from about 10 to 500 nm.

In one embodiment, the lipid nanoparticle may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

Modes of Vaccine Administration

CHIKV, DENV and/or ZIKV RNA vaccines, including combination RNA vaccines, may be administered by any route which results in a therapeutically effective outcome. These include, but are not limited, to intradermal, intramuscular, and/or subcutaneous administration. The present disclosure provides methods comprising administering RNA vaccines to a subject in need thereof. The exact amount required will vary from subject to subject, depending on the species, age, and general condition of the subject, the severity of the disease, the particular composition, its mode of administration, its mode of activity, and the like. CHIKV, DENV and/or ZIKV RNA vaccines, including combination RNA vaccines, compositions are typically formulated in dosage unit form for ease of administration and uniformity of dosage. It will be understood, however, that the total daily usage of CHIKV, DENV and/or ZIKV RNA vaccines, including combination RNA vaccines, compositions may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In certain embodiments, CHIKV, DENV and/or ZIKV RNA vaccines, including combination RNA vaccines, may be administered at dosage levels sufficient to deliver 0.0001 mg/kg to 100 mg/kg, 0.001 mg/kg to 0.05 mg/kg, 0.005 mg/kg to 0.05 mg/kg, 0.001 mg/kg to 0.005 mg/kg, 0.05 mg/kg to 0.5 mg/kg, 0.01 mg/kg to 50 mg/kg, 0.1 mg/kg to 40 mg/kg, 0.5 mg/kg to 30 mg/kg, 0.01 mg/kg to 10 mg/kg, 0.1 mg/kg to 10 mg/kg, or 1 mg/kg to 25 mg/kg, of subject body weight per day, one or more times a day, to obtain the desired therapeutic, diagnostic, prophylactic, or imaging effect (see e.g., the range of unit doses described in International Publication No WO2013078199, herein incorporated by reference in its entirety). The desired dosage may be delivered three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used.

In some embodiments, CHIKV, DENV and/or ZIKV RNA vaccines, including combination RNA vaccines, may be administered at dosage levels sufficient to deliver 0.0001 mg/kg to 100 mg/kg, 0.001 mg/kg to 0.05 mg/kg, 0.005 mg/kg to 0.05 mg/kg, 0.001 mg/kg to 0.005 mg/kg, 0.05 mg/kg to 0.5 mg/kg, 0.01 mg/kg to 50 mg/kg, 0.1 mg/kg to 40 mg/kg, 0.5 mg/kg to 30 mg/kg, 0.01 mg/kg to 10 mg/kg, 0.1 mg/kg to 10 mg/kg, or 1 mg/kg to 25 mg/kg, of subject body weight per day, one or more times a day, per week, per month, etc. to obtain the desired therapeutic, diagnostic, prophylactic, or imaging effect (see e.g., the range of unit doses described in International Publication No WO2013078199, herein incorporated by reference in its entirety). The desired dosage may be delivered three times a day, two times a day, once a day, every other day, every third day, every week, every two weeks, every three weeks, every four weeks, every 2 months, every three months, every 6 months, etc. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. In exemplary embodiments, CHIKV, DENV and/or ZIKV RNA vaccines, including combination RNA vaccines, may be administered at dosage levels sufficient to deliver 0.0005 mg/kg to 0.01 mg/kg, e.g., about 0.0005 mg/kg to about 0.0075 mg/kg, e.g., about 0.0005 mg/kg, about 0.001 mg/kg, about 0.002 mg/kg, about 0.003 mg/kg, about 0.004 mg/kg or about 0.005 mg/kg.

In some embodiments, CHIKV, DENV and/or ZIKV RNA vaccines, including combination RNA vaccines, may be administered once or twice (or more) at dosage levels sufficient to deliver 0.025 mg/kg to 0.250 mg/kg, 0.025 mg/kg to 0.500 mg/kg, 0.025 mg/kg to 0.750 mg/kg, or 0.025 mg/kg to 1.0 mg/kg.

In some embodiments, CHIKV, DENV and/or ZIKV RNA vaccines, including combination RNA vaccines, may be administered twice (e.g., Day 0 and Day 7, Day 0 and Day 14, Day 0 and Day 21, Day 0 and Day 28, Day 0 and Day 60, Day 0 and Day 90, Day 0 and Day 120, Day 0 and Day 150, Day 0 and Day 180, Day 0 and 3 months later, Day 0 and 6 months later, Day 0 and 9 months later, Day 0 and 12 months later, Day 0 and 18 months later, Day 0 and 2 years later, Day 0 and 5 years later, or Day 0 and 10 years later) at a total dose of or at dosage levels sufficient to deliver a total dose of 0.0100 mg, 0.025 mg, 0.050 mg, 0.075 mg, 0.100 mg, 0.125 mg, 0.150 mg, 0.175 mg, 0.200 mg, 0.225 mg, 0.250 mg, 0.275 mg, 0.300 mg, 0.325 mg, 0.350 mg, 0.375 mg, 0.400 mg, 0.425 mg, 0.450 mg, 0.475 mg, 0.500 mg, 0.525 mg, 0.550 mg, 0.575 mg, 0.600 mg, 0.625 mg, 0.650 mg, 0.675 mg, 0.700 mg, 0.725 mg, 0.750 mg, 0.775 mg, 0.800 mg, 0.825 mg, 0.850 mg, 0.875 mg, 0.900 mg, 0.925 mg, 0.950 mg, 0.975 mg, or 1.0 mg. Higher and lower dosages and frequency of administration are encompassed by the present disclosure. For example, a CHIKV, DENV and/or ZIKV RNA vaccines, including combination RNA vaccines, may be administered three or four times.

In some embodiments, CHIKV, DENV and/or ZIKV RNA vaccines, including combination RNA vaccines, may be administered twice (e.g., Day 0 and Day 7, Day 0 and Day 14, Day 0 and Day 21, Day 0 and Day 28, Day 0 and Day 60, Day 0 and Day 90, Day 0 and Day 120, Day 0 and Day 150, Day 0 and Day 180, Day 0 and 3 months later, Day 0 and 6 months later, Day 0 and 9 months later, Day 0 and 12 months later, Day 0 and 18 months later, Day 0 and 2 years later, Day 0 and 5 years later, or Day 0 and 10 years later) at a total dose of or at dosage levels sufficient to deliver a total dose of 0.010 mg, 0.025 mg, 0.100 mg or 0.400 mg.

In some embodiments the RNA vaccine for use in a method of vaccinating a subject is administered the subject a single dosage of between 10 μg/kg and 400 μg/kg of the nucleic acid vaccine in an effective amount to vaccinate the subject. In some embodiments the RNA vaccine for use in a method of vaccinating a subject is administered the subject a single dosage of between 10 μg and 400 μg of the nucleic acid vaccine in an effective amount to vaccinate the subject.

A RNA vaccine pharmaceutical composition described herein can be formulated into a dosage form described herein, such as an intranasal, intratracheal, or injectable (e.g., intravenous, intraocular, intravitreal, intramuscular, intradermal, intracardiac, intraperitoneal, and subcutaneous).

In some embodiments, a RNA (e.g., mRNA) vaccine for use in a method of vaccinating a subject is administered the subject a single dosage of 10 μg of the nucleic acid vaccine in an effective amount to vaccinate the subject. In some embodiments, a RNA vaccine for use in a method of vaccinating a subject is administered the subject a single dosage of 2 μg of the nucleic acid vaccine in an effective amount to vaccinate the subject. In some embodiments, a vaccine for use in a method of vaccinating a subject is administered the subject two dosages of 10 μg of the nucleic acid vaccine in an effective amount to vaccinate the subject. In some embodiments, a RNA vaccine for use in a method of vaccinating a subject is administered the subject two dosages of 2 μg of the nucleic acid vaccine in an effective amount to vaccinate the subject.

A RNA (e.g. mRNA) vaccine pharmaceutical composition described herein can be formulated into a dosage form described herein, such as an intranasal, intratracheal, or injectable (e.g., intravenous, intraocular, intravitreal, intramuscular, intradermal, intracardiac, intraperitoneal, and subcutaneous).

RNA Vaccine Formulations and Methods of Use

Some aspects of the present disclosure provide formulations of a RNA (e.g., mRNA) vaccine, wherein the RNA vaccine is formulated in an effective amount to produce an antigen specific immune response in a subject (e.g., production of antibodies specific to a CHIKV, DENV and/or ZIKV antigenic polypeptide). "An effective amount" is a dose of an RNA (e.g., mRNA) vaccine effective to produce an antigen-specific immune response. Also provided herein are methods of inducing an antigen-specific immune response in a subject.

In some embodiments, the antigen-specific immune response is characterized by measuring an anti-CHIKV, anti-DENV and/or anti-ZIKV antigenic polypeptide antibody titer produced in a subject administered a RNA (e.g., mRNA) vaccine as provided herein. An antibody titer is a measurement of the amount of antibodies within a subject, for example, antibodies that are specific to a particular antigen or epitope of an antigen. Antibody titer is typically expressed as the inverse of the greatest dilution that provides a positive result. Enzyme-linked immunosorbent assay (ELISA) is a common assay for determining antibody titers, for example.

In some embodiments, an antibody titer is used to assess whether a subject has had an infection or to determine whether immunizations are required. In some embodiments, an antibody titer is used to determine the strength of an autoimmune response, to determine whether a booster immunization is needed, to determine whether a previous vaccine was effective, and to identify any recent or prior infections. In accordance with the present disclosure, an antibody titer may be used to determine the strength of an immune response induced in a subject by the RNA vaccine.

In some embodiments, an anti-ZIKV antigenic polypeptide antibody titer produced in a subject is increased by at least 1 log relative to a control. For example, antibody titer produced in a subject may be increased by at least 1.5, at least 2, at least 2.5, or at least 3 log relative to a control. In some embodiments, the antibody titer produced in the subject is increased by 1, 1.5, 2, 2.5 or 3 log relative to a control. In some embodiments, the antibody titer produced in the subject is increased by 1-3 log relative to a control. For example, the antibody titer produced in a subject may be increased by 1-1.5, 1-2, 1-2.5, 1-3, 1.5-2, 1.5-2.5, 1.5-3, 2-2.5, 2-3, or 2.5-3 log relative to a control.

In some embodiments, the antibody titer produced in a subject is increased at least 2 times relative to a control. For example, the antibody titer produced in a subject may be increased at least 3 times, at least 4 times, at least 5 times, at least 6 times, at least 7 times, at least 8 times, at least 9 times, or at least 10 times relative to a control. In some embodiments, the antibody titer produced in the subject is increased 2, 3, 4, 5, 6, 7, 8, 9, or 10 times relative to a control. In some embodiments, the anti antibody titer produced in a subject is increased 2-10 times relative to a control. For example, the antibody titer produced in a subject may be increased 2-10, 2-9, 2-8, 2-7, 2-6, 2-5, 2-4, 2-3, 3-10, 3-9, 3-8, 3-7, 3-6, 3-5, 3-4, 4-10, 4-9, 4-8, 4-7, 4-6, 4-5, 5-10, 5-9, 5-8, 5-7, 5-6, 6-10, 6-9, 6-8, 6-7, 7-10, 7-9, 7-8, 8-10, 8-9, or 9-10 times relative to a control.

A control, in some embodiments, is an anti-CHIKV, anti-DENV and/or anti-ZIKV antigenic polypeptide antibody titer produced in a subject who has not been administered a RNA (e.g., mRNA) vaccine. In some embodiments, a control is an anti-CHIKV, anti-DENV and/or anti-ZIKV antibody titer produced in a subject who has been administered a live attenuated CHIKV, DENV and/or ZIKV vaccine. An attenuated vaccine is a vaccine produced by reducing the virulence of a viable (live). An attenuated virus is altered in a manner that renders it harmless or less virulent relative to live, unmodified virus. In some embodiments, a control is an anti-CHIKV, anti-DENV and/or anti-ZIKV antigenic polypeptide antibody titer produced in a subject administered inactivated CHIKV, DENV and/or ZIKV vaccine. In some embodiments, a control is an anti-CHIKV, anti-DENV and/or anti-ZIKV antigenic polypeptide antibody titer produced in a subject administered a recombinant or purified CHIKV, DENV and/or ZIKV protein vaccine. Recombinant protein vaccines typically include protein antigens that either have been produced in a heterologous expression system (e.g., bacteria or yeast) or purified from large amounts of the pathogenic organism.

In some embodiments, an effective amount of a RNA (e.g., mRNA) vaccine is a dose that is reduced compared to the standard of care dose of a recombinant CHIKV, DENV and/or ZIKV protein vaccine. A "standard of care," as provided herein, refers to a medical or psychological treatment guideline and can be general or specific. "Standard of care" specifies appropriate treatment based on scientific evidence and collaboration between medical professionals involved in the treatment of a given condition. It is the diagnostic and treatment process that a physician/clinician should follow for a certain type of patient, illness or clinical circumstance. A "standard of care dose," as provided herein, refers to the dose of a recombinant or purified CHIKV, DENV and/or ZIKV protein vaccine, or a live attenuated or inactivated CHIKV, DENV and/or ZIKV vaccine, that a physician/clinician or other medical professional would administer to a subject to treat or prevent CHIKV, DENV and/or ZIKV or a related condition, while following the standard of care guideline for treating or preventing CHIKV, DENV and/or ZIKV, or a related condition.

In some embodiments, the anti-CHIKV, anti-DENV and/or anti-ZIKV antigenic polypeptide antibody titer produced in a subject administered an effective amount of a ZIKV RNA vaccine is equivalent to an anti-CHIKV, anti-DENV and/or anti-ZIKV antigenic polypeptide antibody titer produced in a control subject administered a standard of care dose of a recombinant or purified CHIKV, DENV and/or ZIKV protein vaccine or a live attenuated or inactivated CHIKV, DENV and/or ZIKV vaccine.

In some embodiments, an effective amount of a RNA (e.g., mRNA) vaccine is a dose equivalent to an at least 2-fold reduction in a standard of care dose of a recombinant or purified CHIKV, DENV and/or ZIKV protein vaccine. For example, an effective amount of a CHIKV, DENV and/or ZIKV RNA vaccine may be a dose equivalent to an at least 3-fold, at least 4-fold, at least 5-fold, at least 6-fold, at least 7-fold, at least 8-fold, at least 9-fold, or at least 10-fold reduction in a standard of care dose of a recombinant or purified CHIKV, DENV and/or ZIKV protein vaccine. In some embodiments, an effective amount of a CHIKV, DENV and/or ZIKV RNA vaccine is a dose equivalent to an at least at least 100-fold, at least 500-fold, or at least 1000-fold reduction in a standard of care dose of a recombinant or purified CHIKV, DENV and/or ZIKV protein vaccine. In some embodiments, an effective amount of a CHIKV, DENV and/or ZIKV RNA vaccine is a dose equivalent to a 2-, 3-, 4-, 5-, 6-, 7-, 8-, 9-, 10-, 20-, 50-, 100-, 250-, 500-, or 1000-fold reduction in a standard of care dose of a recombinant or purified CHIKV, DENV and/or ZIKV protein vaccine. In some embodiments, the anti-CHIKV, anti-DENV and/or anti-ZIKV antigenic polypeptide antibody titer produced in a subject administered an effective amount of a CHIKV, DENV and/or ZIKV RNA vaccine is equivalent to an anti-CHIKV, anti-DENV and/or anti-ZIKV antigenic polypeptide antibody titer produced in a control subject administered the standard of care dose of a recombinant or protein CHIKV, DENV and/or ZIKV protein vaccine or a live attenuated or inactivated CHIKV, DENV and/or ZIKV vaccine. In some embodiments, an effective amount of a RNA (e.g., mRNA) vaccine is a dose equivalent to a 2-fold to 1000-fold (e.g., 2-fold to 100-fold, 10-fold to 1000-fold) reduction in the standard of care dose of a recombinant or purified CHIKV, DENV and/or ZIKV protein vaccine, wherein the anti-CHIKV, anti-DENV and/or anti-ZIKV antigenic polypeptide antibody titer produced in the subject is equivalent to an anti-CHIKV, anti-DENV and/or anti-ZIKV antigenic polypeptide antibody titer produced in a control subject administered the standard of care dose of a recombinant or purified CHIKV, DENV and/or ZIKV protein vaccine or a live attenuated or inactivated CHIKV, DENV and/or ZIKV vaccine.

In some embodiments, the effective amount of a RNA (e.g., mRNA) vaccine is a dose equivalent to a 2 to 1000-, 2 to 900-, 2 to 800-, 2 to 700-, 2 to 600-, 2 to 500-, 2 to 400-, 2 to 300-, 2 to 200-, 2 to 100-, 2 to 90-, 2 to 80-, 2 to 70-, 2 to 60-, 2 to 50-, 2 to 40-, 2 to 30-, 2 to 20-, 2 to 10-, 2 to 9-, 2 to 8-, 2 to 7-, 2 to 6-, 2 to 5-, 2 to 4-, 2 to 3-, 3 to 1000-, 3 to 900-, 3 to 800-, 3 to 700-, 3 to 600-, 3 to 500-, 3 to 400-, 3 to 3 to 00-, 3 to 200-, 3 to 100-, 3 to 90-, 3 to 80-, 3 to 70-, 3 to 60-, 3 to 50-, 3 to 40-, 3 to 30-, 3 to 20-, 3 to 10-, 3 to 9-, 3 to 8-, 3 to 7-, 3 to 6-, 3 to 5-, 3 to 4-, 4 to 1000-, 4 to 900-, 4 to 800-, 4 to 700-, 4 to 600-, 4 to 500-, 4 to 400-, 4 to 4 to 00-, 4 to 200-, 4 to 100-, 4 to 90-, 4 to 80-, 4 to 70-, 4 to 60-, 4 to 50-, 4 to 40-, 4 to 30-, 4 to 20-, 4 to 10-, 4 to 9-, 4 to 8-, 4 to 7-, 4 to 6-, 4 to 5-, 4 to 4-, 5 to 1000-, 5 to 900-, 5 to 800-, 5 to 700-, 5 to 600-, 5 to 500-, 5 to 400-, 5 to 300-, 5 to 200-, 5 to 100-, 5 to 90-, 5 to 80-, 5 to 70-, 5 to 60-, 5 to 50-, 5 to 40-, 5 to 30-, 5 to 20-, 5 to 10-, 5 to 9-, 5 to 8-, 5 to 7-, 5 to 6-, 6 to 1000-, 6 to 900-, 6 to 800-, 6 to 700-, 6 to 600-, 6 to 500-, 6 to 400-, 6 to 300-, 6 to 200-, 6 to 100-, 6 to 90-, 6 to 80-, 6 to 70-, 6 to 60-, 6 to 50-, 6 to 40-, 6 to 30-, 6 to 20-, 6 to 10-, 6 to 9-, 6 to 8-, 6 to 7-, 7 to 1000-, 7 to 900-, 7 to 800-, 7 to 700-, 7 to 600-, 7 to 500-, 7 to 400-, 7 to 300-, 7 to 200-, 7 to 100-, 7 to 90-, 7 to 80-, 7 to 70-, 7 to 60-, 7 to 50-, 7 to 40-, 7 to 30-, 7 to 20-, 7 to 10-, 7 to 9-, 7 to 8-, 8 to 1000-, 8 to 900-, 8 to 800-, 8 to 700-, 8 to 600, 8 to 500-, 8 to 400-, 8 to 300-, 8 to 200-, 8 to 100-, 8 to 90-, 8 to 80-, 8 to 70-, 8 to 60-, 8 to 50-, 8 to 40-, 8 to 30-, 8 to 20-, 8 to 10-, 8 to 9-, 9 to 1000-, 9 to 900-, 9 to 800-, 9 to 700-, 9 to 600-, 9 to 500-, 9 to 400-, 9 to 300-, 9 to 200-, 9 to 100-, 9 to 90-, 9 to 80-, 9 to 70-, 9 to 60-, 9 to 50-, 9 to 40-, 9 to 30-, 9 to 20-, 9 to 10-, 10 to 1000-, 10 to 900-, 10 to 800-, 10 to 700-, 10 to 600-, 10 to 500-, 10 to 400-, 10 to 300-, 10 to 200-, 10 to 100-, 10 to 90-, 10 to 80-, 10 to 70-, 10 to 60-, 10 to 50-, 10 to 40-, 10 to 30-, 10 to 20-, 20 to 1000-, 20 to 900-, 20 to 800-, 20 to 700-, 20 to 600-, 20 to 500-, 20 to 400-, 20 to 300-, 20 to 200-, 20 to 100-, 20 to 90-, 20 to 80-, 20 to 70-, 20 to 60-, 20 to 50-, 20 to 40-, 20 to 30-, 30 to 1000-, 30 to 900-, 30 to 800-, 30 to 700-, 30 to 600-, 30 to 500-, 30 to 400-, 30 to 300-, 30 to 200-, 30 to 100-, 30 to 90-, 30 to 80-, 30 to 70-, 30 to 60-, 30 to 50-, 30 to 40-, 40 to 1000-, 40 to 900-, 40 to 800-, 40 to 700-, 40 to 600-, 40 to 500-, 40 to 400-, 40 to 300-, 40 to 200-, 40 to 100-, 40 to 90-, 40 to 80-, 40 to 70-, 40 to 60-, 40 to 50-, 50 to 1000-, 50 to 900-, 50 to 800-, 50 to 700-, 50 to 600-, 50 to 500-, 50 to 400-, 50 to 300-, 50 to 200-, 50 to 100-, 50 to 90-, 50 to 80-, 50 to 70-, 50 to 60-, 60 to 1000-, 60 to 900-, 60 to 800-, 60 to 700-, 60 to 600-, 60 to 500-, 60 to 400-, 60 to 300-, 60 to 200-, 60 to 100-, 60 to 90-, 60 to 80-, 60 to 70-, 70 to 1000-, 70 to 900-, 70 to 800-, 70 to 700-, 70 to 600-, 70 to 500-, 70 to 400-, 70 to 300-, 70 to 200-, 70 to 100-, 70 to 90-, 70 to 80-, 80 to 1000-, 80 to 900-, 80 to 800-, 80 to 700-, 80 to 600-, 80 to 500-, 80 to 400-, 80 to 300-, 80 to 200-, 80 to 100-, 80 to 90-, 90 to 1000-, 90 to 900-, 90 to 800-, 90 to 700-, 90 to 600-, 90 to 500-, 90 to 400-, 90 to 300-, 90 to 200-, 90 to 100-, 100 to 1000-, 100 to 900-, 100 to 800-, 100 to 700-, 100 to 600-, 100 to 500-, 100 to 400-, 100 to 300-, 100 to 200-, 200 to 1000-, 200 to 900-, 200 to 800-, 200 to 700-, 200 to 600-, 200 to 500-, 200 to 400-, 200 to 300-, 300 to 1000-, 300 to 900-, 300 to 800-, 300 to 700-, 300 to 600-, 300 to 500-, 300 to 400-, 400 to 1000-, 400 to 900-, 400 to 800-, 400 to 700-, 400 to 600-, 400 to 500-, 500 to 1000-, 500 to 900-, 500 to 800-, 500 to 700-, 500 to 600-, 600 to 1000-, 600 to 900-, 600 to 800-, 600 to 700-, 700 to 1000-, 700 to 900-, 700 to 800-, 800 to 1000-, 800 to 900-, or 900 to 1000-fold reduction in the standard of care dose of a recombinant CHIKV, DENV and/or ZIKV protein vaccine. In some embodiments, such as the foregoing, the anti-CHIKV, anti-DENV and/or anti-ZIKV antigenic polypeptide antibody titer produced in the subject is equivalent to an anti-CHIKV, anti-DENV and/or anti-ZIKV antigenic polypeptide antibody titer produced in a control subject administered the standard of care dose of a recombinant or purified CHIKV, DENV and/or ZIKV protein vaccine or a live attenuated or inactivated CHIKV, DENV and/or ZIKV vaccine. In some embodiments, the effective amount is a dose equivalent to (or equivalent to an at least) 2-, 3-, 4-, 5-, 6-, 7-, 8-, 9-, 10-, 20-, 30-, 40-, 50-, 60-, 70-, 80-, 90-, 100-, 110-, 120-, 130-, 140-, 150-, 160-, 170-, 1280-, 190-, 200-, 210-, 220-, 230-, 240-, 250-, 260-, 270-, 280-, 290-, 300-, 310-, 320-, 330-, 340-, 350-, 360-, 370-, 380-, 390-, 400-, 410-, 420-, 430-, 440-, 450-, 4360-, 470-, 480-, 490-, 500-, 510-, 520-, 530-, 540-, 550-, 560-, 5760-, 580-, 590-, 600-, 610-, 620-, 630-, 640-, 650-, 660-, 670-, 680-, 690-, 700-, 710-, 720-, 730-, 740-, 750-, 760-, 770-, 780-, 790-, 800-, 810-, 820-, 830-, 840-, 850-, 860-, 870-, 880-, 890-, 900-, 910-, 920-, 930-, 940-, 950-, 960-, 970-, 980-, 990-, or 1000-fold reduction in the standard of care dose of a recombinant CHIKV, DENV and/or ZIKV protein vaccine. In some embodiments, such as the foregoing, an anti-CHIKV, anti-DENV and/or anti-ZIKV antigenic polypeptide antibody titer produced in the subject is equivalent to an anti-CHIKV, anti-DENV and/or anti-ZIKV antigenic polypeptide antibody titer produced in a control subject administered the standard of care dose of a recombinant or purified CHIKV, DENV and/or ZIKV protein vaccine or a live attenuated or inactivated CHIKV, DENV and/or ZIKV vaccine.

In some embodiments, the effective amount of a RNA (e.g., mRNA) vaccine is a total dose of 50-1000 μg. In some embodiments, the effective amount of a RNA (e.g., mRNA) vaccine is a total dose of 50-1000, 50-900, 50-800, 50-700, 50-600, 50-500, 50-400, 50-300, 50-200, 50-100, 50-90, 50-80, 50-70, 50-60, 60-1000, 60-900, 60-800, 60-700, 60-600, 60-500, 60-400, 60-300, 60-200, 60-100, 60-90, 60-80, 60-70, 70-1000, 70-900, 70-800, 70-700, 70-600, 70-500, 70-400, 70-300, 70-200, 70-100, 70-90, 70-80, 80-1000, 80-900, 80-800, 80-700, 80-600, 80-500, 80-400, 80-300, 80-200, 80-100, 80-90, 90-1000, 90-900, 90-800, 90-700, 90-600, 90-500, 90-400, 90-300, 90-200, 90-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-900, 600-700, 700-1000, 700-900, 700-800, 800-1000, 800-900, or 900-1000 μg. In some embodiments, the effective amount of a RNA (e.g., mRNA) vaccine is a total dose of 50, 100, 150, 200, 250, 300, 350, 400, 450, 500, 550, 600, 650, 700, 750, 800, 850, 900, 950 or 1000 jig. In some embodiments, the effective amount is a dose of 25-500 μg administered to the subject a total of two times. In some embodiments, the effective amount of a RNA (e.g., mRNA) vaccine is a dose of 25-500, 25-400, 25-300, 25-200, 25-100, 25-50, 50-500, 50-400, 50-300, 50-200, 50-100, 100-500, 100-400, 100-300, 100-200, 150-500, 150-400, 150-300, 150-200, 200-500, 200-400, 200-300, 250-500, 250-400, 250-300, 300-500, 300-400, 350-500, 350-400, 400-500 or 450-500 μg administered to the subject a total of two times. In some embodiments, the effective amount of a RNA (e.g., mRNA) vaccine is a total dose of 25, 50, 100, 150, 200, 250, 300, 350, 400, 450, or 500 μg administered to the subject a total of two times.

This invention is not limited in its application to the details of construction and the arrangement of components set forth in the following description or illustrated in the drawings. The invention is capable of other embodiments and of being practiced or of being carried out in various ways. Also, the phraseology and terminology used herein is for the purpose of description and should not be regarded as limiting. The use of "including," "comprising," or "having," "containing," "involving," and variations thereof herein, is meant to encompass the items listed thereafter and equivalents thereof as well as additional items.

EXAMPLES

Example 1: Manufacture of Polynucleotides

According to the present disclosure, the manufacture of polynucleotides and or parts or regions thereof may be accomplished utilizing the methods taught in International Application WO2014/152027 entitled "Manufacturing Methods for Production of RNA Transcripts", the contents of which is incorporated herein by reference in its entirety.

Purification methods may include those taught in International Application WO2014/152030 and WO2014/152031, each of which is incorporated herein by reference in its entirety.

Detection and characterization methods of the polynucleotides may be performed as taught in WO2014/144039, which is incorporated herein by reference in its entirety.

Characterization of the polynucleotides of the disclosure may be accomplished using a procedure selected from the group consisting of polynucleotide mapping, reverse transcriptase sequencing, charge distribution analysis, and detection of RNA impurities, wherein characterizing comprises determining the RNA transcript sequence, determining the purity of the RNA transcript, or determining the charge heterogeneity of the RNA transcript. Such methods are taught in, for example, WO2014/144711 and WO2014/144767, the contents of each of which is incorporated herein by reference in its entirety.

Example 2: Chimeric Polynucleotide Synthesis

Introduction

According to the present disclosure, two regions or parts of a chimeric polynucleotide may be joined or ligated using triphosphate chemistry.

According to this method, a first region or part of 100 nucleotides or less is chemically synthesized with a 5' monophosphate and terminal 3'desOH or blocked OH. If the region is longer than 80 nucleotides, it may be synthesized as two strands for ligation.

If the first region or part is synthesized as a non-positionally modified region or part using in vitro transcription (IVT), conversion the 5'monophosphate with subsequent capping of the 3' terminus may follow.

Monophosphate protecting groups may be selected from any of those known in the art.

The second region or part of the chimeric polynucleotide may be synthesized using either chemical synthesis or IVT methods. IVT methods may include an RNA polymerase that can utilize a primer with a modified cap. Alternatively, a cap of up to 130 nucleotides may be chemically synthesized and coupled to the IVT region or part.

It is noted that for ligation methods, ligation with DNA T4 ligase, followed by treatment with DNAse should readily avoid concatenation.

The entire chimeric polynucleotide need not be manufactured with a phosphate-sugar backbone. If one of the regions or parts encodes a polypeptide, then it is preferable that such region or part comprise a phosphate-sugar backbone.

Ligation is then performed using any known click chemistry, orthoclick chemistry, solulink, or other bioconjugate chemistries known to those in the art.

Synthetic Route

The chimeric polynucleotide is made using a series of starting segments. Such segments include:

(a) Capped and protected 5' segment comprising a normal 3'OH (SEG. 1)

(b) 5' triphosphate segment which may include the coding region of a polypeptide and comprising a normal 3'OH (SEG. 2)

(c) 5' monophosphate segment for the 3' end of the chimeric polynucleotide (e.g., the tail) comprising cordycepin or no 3'OH (SEG. 3)

After synthesis (chemical or IVT), segment 3 (SEG. 3) is treated with cordycepin and then with pyrophosphatase to create the 5'monophosphate.

Segment 2 (SEG. 2) is then ligated to SEG. 3 using RNA ligase. The ligated polynucleotide is then purified and treated with pyrophosphatase to cleave the diphosphate. The treated SEG.2-SEG. 3 construct is then purified and SEG. 1 is ligated to the 5' terminus. A further purification step of the chimeric polynucleotide may be performed.

Where the chimeric polynucleotide encodes a polypeptide, the ligated or joined segments may be represented as: 5'UTR (SEG. 1), open reading frame or ORF (SEG. 2) and 3'UTR+PolyA (SEG. 3).

The yields of each step may be as much as 90-95%.

Example 3: PCR for cDNA Production

PCR procedures for the preparation of cDNA are performed using 2× KAPA HIFI™ HotStart ReadyMix by Kapa Biosystems (Woburn, Ma.). This system includes 2× KAPA ReadyMix12.5 μl; Forward Primer (10 μM) 0.75 μl; Reverse Primer (10 μM) 0.75 μl; Template cDNA −100 ng; and dH20 diluted to 25.0 μl. The reaction conditions are at 95° C. for 5 min. and 25 cycles of 98° C. for 20 sec, then 58° C. for 15 sec, then 72° C. for 45 sec, then 72° C. for 5 min. then 4° C. to termination.

The reaction is cleaned up using Invitrogen's PURELINK™ PCR Micro Kit (Carlsbad, Calif.) per manufacturer's instructions (up to 5 μg). Larger reactions will require a cleanup using a product with a larger capacity. Following the cleanup, the cDNA is quantified using the NANODROP™ and analyzed by agarose gel electrophoresis to confirm the cDNA is the expected size. The cDNA is then submitted for sequencing analysis before proceeding to the in vitro transcription reaction.

Example 4: In Vitro Transcription (IVT)

The in vitro transcription reaction generates polynucleotides containing uniformly modified polynucleotides. Such uniformly modified polynucleotides may comprise a region or part of the polynucleotides of the disclosure. The input nucleotide triphosphate (NTP) mix is made in-house using natural and un-natural NTPs.

A typical in vitro transcription reaction includes the following:

| | | |
|---|---|---|
| 1 | Template cDNA | 1.0 μg |
| 2 | 10x transcription buffer (400 mM Tris-HCl pH 8.0, 190 mM MgCl2, 50 mM DTT, 10 mM Spermidine) | 2.0 μl |
| 3 | Custom NTPs (25 mM each) | 7.2 μl |
| 4 | RNase Inhibitor | 20 U |
| 5 | T7 RNA polymerase | 3000 U |
| 6 | dH20 | Up to 20.0 μl. and |
| 7 | Incubation at 37° C. for 3 hr-5 hrs. | |

The crude IVT mix may be stored at 4° C. overnight for cleanup the next day. 1 U of RNase-free DNase is then used to digest the original template. After 15 minutes of incubation at 37° C., the mRNA is purified using Ambion's MEGACLEAR™ Kit (Austin, Tex.) following the manufacturer's instructions. This kit can purify up to 500 μg of RNA. Following the cleanup, the RNA is quantified using the NanoDrop and analyzed by agarose gel electrophoresis to confirm the RNA is the proper size and that no degradation of the RNA has occurred.

Example 5: Exemplary Nucleic Acids Encoding CHIKV E1 RNA Polynucleotides for Use in a RNA Vaccine The following sequences are exemplary sequences that can be used to encode CHIKV E1 RNA polynucleotides for use in the CHIKV RNA vaccine:

TABLE 1

| CHIKV E1 RNA polynucleotides | | |
|---|---|---|
| Name | Sequence | SEQ ID NO |
| ChiK.secE1 HS3UPCRfree (CHIKV secreted E1 antigen) | TCAAGCTTTTGGACCCTCGTACAGAAGCTAATACGACTCACTATAGGGAA<br>ATAAGAGAGAAAAGAAGAGTAAGAAGAAATATAAGAGCCACCATGGAGAC<br>ACCTGCACAGCTGTTGTTTCTGCTGCTGCTTTGGTTGCCCGATACCACCG<br>GTGACTACAAAGACGACGACGATAAATACGAGCACGTGACGGTAATACCA<br>AACACTGTGGGGGTGCCATACAAGACCCTGGTAAATCGCCCAGGCTACTC<br>TCCCATGGTGCTGGAGATGGAGCTCCAGTCTGTGACCTTAGAGCCAACCC<br>TCTCACTCGACTATATCACCTGTGAATACAAAACAGTGATCCCATCCCCC<br>TACGTGAAATGTTGCGGAACTGCAGAGTGTAAGGATAAGAGTCTGCCCGA<br>TTACAGCTGCAAGGTGTTTACAGGCGTGTATCCATTTATGTGGGGAGGAG<br>CCTACTGTTTTTGCGATGCCGAAAATACTCAGCTGTCTGAAGCCCATGTG<br>GAGAAGAGTGAAAGTTGCAAGACCGAATTTGCTAGTGCCTACAGGGCACA<br>CACCGCTTCTGCCTCCGCTAAACTCCGAGTCCTTTACCAGGGCAATAATA<br>TTACGGTCGCTGCCTACGCTAACGGGGACCACGCTGTGACAGTCAAGGAC<br>GCCAAATTCGTAGTGGGCCCAATGAGCTCCGCCTGGACTCCCTTCGACAA<br>CAAAATCGTCGTGTATAAAGGCGACGTGTACAATATGGACTACCCACCCT<br>TCGGGGCTGGAAGACCGGGCCAGTTTGGAGATATCCAATCAAGGACACCC<br>GAGTCAAAGGACGTGTACGCCAATACGCAGCTGGTGCTGCAGAGACCCGC<br>CGCTGGTACCGTGCATGTGCCTTATTCCCAAGCTCCATCTGGCTTCAAGT<br>ACTGGTTGAAAGAGCGCGGTGCTTCGCTGCAGCATACAGCACCGTTCGGA<br>TGTCAGATAGCAACCAACCCTGTACGGGCTGTCAACTGTGCCGTGGGAAA<br>TATACCTATTTCCATCGACATTCCGGACGCAGCTTTCACACGTGTCGTTG<br>ATGCCCCCTCAGTGACTGACATGTCATGTGAGGTGCCTGCTTGCACCCAC<br>AGCAGCGATTTTGGCGGAGTGGCCATAATCAAGTACACCGCCTCCAAAAA<br>AGGAAAGTGTGCCGTACACTCTATGACCAACGCCGTCACAATCAGAGAAG<br>CCGACGTTGAAGTAGAGGGAAATTCACAGCTGCAAATCAGCTTCAGCACC<br>GCTCTTGCCTCTGCTGAGTTTAGGGTTCAGGTTTGCAGTACTCAGGTGCA<br>CTGTGCAGCCGCTTGCCATCCCCCCAAGGATCATATCGTGAATTATCCTG<br>CATCCCACACCACACTGGGAGTCCAGGATATCTCAACAACTGCAATGTCT<br>TGGGTGCAGAAGATCACCTGATAATAGGCTGGAGCCTCGGTGGCCATGCT<br>TCTTGCCCCTTGGGCCTCCCCCCAGCCCCTCCTCCCCTTCCTGCACCCGT<br>ACCCCCGTGGTCTTTGAATAAAGTCTGAGTGGGCGGC | 1 |
| Chik-Strain37997-E1 (CHIKV E1 antigen-Strain 37997): | TCAAGCTTTTGGACCCTCGTACAGAAGCTAATACGACTCACTATAGGGAA<br>ATAAGAGAGAAAAGAAGAGTAAGAAGAAATATAAGAGCCACCATGTACGA<br>ACACGTAACAGTGATCCCGAACACGGTGGGAGTACCGTATAAGACTCTAG<br>TCAACAGACCGGGCTACAGCCCCATGGTATTGGAGATGGAGCTTCTGTCT<br>GTCACCTTGGAACCAACGCTATCGCTTGATTACATCACGTGCGAGTATAA<br>AACCGTTATCCCGTCTCCGTACGTGAAATGCTGCGGTACAGCAGAGTGTA<br>AGGACAAGAGCCTACCTGATTACAGCTGTAAGGTCTTCACCGGCGTCTAC<br>CCATTCATGTGGGGCGGCGCCTACTGCTTCTGCGACACCGAAAATACGCA<br>ATTGAGCGAAGCACATGTGGAGAAGTCCGAATCATGCAAAACAGAATTTG<br>CATCAGCATACAGGGCTCATACCGCATCCGCATCAGCTAAGCTCCGCGTC<br>CTTTACCAAGGAAATAATATCACTGTGGCTGCTTATGCAAACGGCGACCA<br>TGCCGTCACAGTTAAGGACGCTAAATTCATAGTGGGGCCAATGTCTTCAG<br>CCTGGACACCTTTCGACAATAAAATCGTGGTGTACAAAGGCGACGTCTAC<br>AACATGGACTACCCGCCCTTCGGCGCAGGAAGACCAGGACAATTTGGCGA<br>CATCCAAAGTCGCACGCCTGAGAGCGAAGACGTCTATGCTAATACACAAC<br>TGGTACTGCAGAGACCGTCCGCGGGTACGGTGCACGTGCCGTACTCTCAG<br>GCACCATCTGGCTTCAAGTATTGGCTAAAAGAACGAGGGGCGTCGCTGCA<br>GCACACAGCACCATTTGGCTGTCAAATAGCAACAAACCCGGTAAGAGCGA<br>TGAACTGCGCCGTAGGGAACATGCCTATCTCCATCGACATACCGGACGCG<br>GCCTTTACCAGGGTCGTCGACGCGCCATCTTTAACGGACATGTCGTGTGA<br>GGTATCAGCCTGCACCCATTCCTCAGACTTTGGGGGCGTAGCCATCATTA<br>AATATGCAGCCAGTAAGAAAGGCAAGTGTGCAGTGCACTCGATGACTAAC<br>GCCGTCACTATTCGGGAAGCTGAAATAGAAGTAGAAGGGAACTCTCAGTT<br>GCAAATCTCTTTTTCGACGGCCCTAGCCAGCGCCGAATTTCGCGTACAAG<br>TCTGTTCTACACAAGTACACTGTGCAGCCGAGTGCCATCCACCGAAAGAC<br>CATATAGTCAATTACCCGGCGTCACACACCACCCTCGGGGTCCAAGACAT<br>TTCCGCTACGGCGATGTCATGGGTGCAGAAGATCACGGGAGGTGTGGGAC<br>TGGTTGTCGCTGTTGCAGCACTGATCCTAATCGTGGTGCTATGCGTGTCG<br>TTTAGCAGGCACTGATAATAGGCTGGAGCCTCGGTGGCCATGCTTCTTGC<br>CCCTTGGGCCTCCCCCCAGCCCCTCCTCCCCTTCCTGCACCCGTACCCCC<br>GTGGTCTTTGAATAAAGTCTGAGTGGGCGGC | 2 |
| Chik-Strain37997-E1 (CHIKV E1 antigen-Strain 37997): | TCAAGCTTTTGGACCCTCGTACAGAAGCTAATACGACTCACTATAGGGAA<br>ATAAGAGAGAAAAGAAGAGTAAGAAGAAATATAAGAGCCACCATGCTATG<br>GAACGAACAGCAGCCCCTGTTCTGGTTGCAGGCTCTTATCCCGCTGGCCG<br>CCTTGATCGTCCTGTGCAACTGTCTGAAACTCTTGCCATGCTGCTGTAAG<br>ACCCTGGCTTTTTTAGCCGTAATGAGCATCGGTGCCCACACTGTGAGCGC<br>GTACGAACACGTAACAGTGATCCCGAACACGGTGGGAGTACCGTATAAGA<br>CTCTTGTCAACAGACCGGGTTACAGCCCCATGGTGTTGGAGATGGAGCTA<br>CAATCAGTCACCTTGGAACCAACACTGTCACTTGACTACATCACGTGCGA<br>GTACAAAACTGTCATCCCCTCCCCGTACGTGAAGTGCTGTGGTACAGCAG<br>AGTGCAAGGACAAGAGCCTACCAGACTACAGCTGCAAGGTCTTTACTGGA<br>GTCTACCCATTTATGTGGGGCGGCGCCTACTGCTTTTGCGACGCCGAAAA | 3 |

TABLE 1-continued

CHIKV E1 RNA polynucleotides

| Name | Sequence | SEQ ID NO |
|---|---|---|
| | TACGCAATTGAGCGAGGCACATGTAGAGAAATCTGAATCTTGCAAAACAG<br>AGTTTGCATCGGCCTACAGAGCCCACACCGCATCGGCGTCGGCGAAGCTC<br>CGCGTCCTTTACCAAGGAAACAACATTACCGTAGCTGCCTACGCTAACGG<br>TGACCATGCCGTCACAGTAAAGGACGCCAAGTTTGTCGTGGGCCCAATGT<br>CCTCCGCCTGGACACCTTTTGACAACAAAATCGTGGTGTACAAAGGCGAC<br>GTCTACAACATGGACTACCCACCTTTTGGCGCAGGAAGACCAGGACAATT<br>TGGTGACATTCAAAGTCGTACACCGGAAAGTAAAGACGTTTATGCCAACA<br>CTCAGTTGGTACTACAGAGGCCAGCAGCAGGCACGGTACATGTACCATAC<br>TCTCAGGCACCATCTGGCTTCAAGTATTGGCTGAAGGAACGAGGAGCATC<br>GCTACAGCACACGGCACCGTTCGGTTGCCAGATTGCGACAAACCCGGTAA<br>GAGCTGTAAATTGCGCTGTGGGGAACATACCAATTTCCATCGACATACCG<br>GATGCGGCCTTTACTAGGGTTGTCGATGCACCCTCTGTAACGGACATGTC<br>ATGCGAAGTACCAGCCTGCACTCACTCCTCCGACTTTGGGGGCGTCGCCA<br>TCATCAAATACACAGCTAGCAAGAAAGGTAAATGTGCAGTACATTCGATG<br>ACCAACGCCGTTACCATTCGAGAAGCCGACGTAGAAGTAGAGGGGAACTC<br>CCAGCTGCAAATATCCTTCTCAACAGCCCTGGCAAGCGCCGAGTTTCGCG<br>TGCAAGTGTGCTCCACACAAGTACACTGCGCAGCCGCATGCCACCCTCCA<br>AAGGACCACATAGTCAATTACCCAGCATCACACACCACCCTTGGGGTCCA<br>GGATATATCCACAACGGCAATGTCTTGGGTGCAGAAGATTACGGGAGGAG<br>TAGGATTAATTGTTGCTGTTGCTGCCTTAATTTTAATTGTGGTGCTATGC<br>GTGTCGTTTAGCAGGCACTAATGATAATAGGCTGGAGCCTCGGTGGCCAT<br>GCTTCTTGCCCCTTGGGCCTCCCCCCAGCCCCTCCTCCCCTTCCTGCACC<br>CGTACCCCCGTGGTCTTTGAATAAAGTCTGAGTGGGCGGC | |
| chikv-<br>Brazillian-<br>E1 (CHIKV<br>E1 antigen-<br>Brazilian<br>strain) | TCAAGCTTTTGGACCCTCGTACAGAAGCTAATACGACTCACTATAGGGAA<br>ATAAGAGAGAAAAGAAGAGTAAGAAGAAATATAAGAGCCACCATGTACGA<br>ACACGTAACAGTGATCCCGAACACGGTGGGAGTACCGTATAAGACTCTAG<br>TCAATAGACCGGGCTACAGTCCCATGGTATTGGAGATGGAACTACTGTCA<br>GTCACTTTGGAGCCAACGCTATCGCTTGATTACATCACGTGCGAGTACAA<br>AACCGTTATCCCGTCTCCGTACGTGAAATGCTGCGGTACAGCAGAGTGCA<br>AGGACAAAAACCTACCTGACTACAGCTGTAAGGTCTTCACCGGCGTCTAC<br>CCATTTATGTGGGGCGGAGCCTACTGCTTCTGCGACGCTGAAAACACGCA<br>ATTGAGCGAAGCACACGTGGAGAAGTCCGAATCATGCAAAACAGAATTTG<br>CATCAGCATACAGGGCTCATACCGCATCCGCATCAGCTAAGCTCCGCGTC<br>CTTTACCAAGGAAATAACATCACTGTAACTGCCTATGCTAACGGCGACCA<br>TGCCGTCACAGTTAAGGACGCCAAATTCATTGTGGGGCCAATGTCTTCAG<br>CCTGGACACCTTTCGACAACAAAATTGTGGTGTACAAAGGTGACGTCTAT<br>AACATGGACTACCCGCCCTTTGGCGCAGGAAGACCAGGACAATTTGGCGA<br>TATCCAAAGTCGCACACCTGAGAGTAAAGACGTCTATGCTAATACACAAC<br>TGGTACTGCAGAGACCGGCTGCGGGTACGGTACATGTGCCATACTCTCAG<br>GCACCATCTGGCTTTAAGTATTGGCTAAAAGAACGAGGGGCGTCGCTGCA<br>GCACACAGCACCATTTGGCTGCCAAATAGCAACAAACCCGGTAAGAGCGG<br>TGAATTGCGCCGTAGGGAACATGCCCATCTCCATCGACATACCGGATGCG<br>GCCTTCATTAGGGTCGTCGACGCGCCCTCTTTAACGGACATGTCGTGCGA<br>GGTACCAGCCTGCACCCATTCCTCAGATTTCGGGGGCGTCGCCATTATTA<br>AATATGCAGCCAGCAAGAAAGGCAAGTGTGCGGTGCATTCGATGACCAAC<br>GCCGTCACAATTCGGGAAGCTGAGATAGAAGTTGAAGGGAATTCTCAGCT<br>GCAAATCTCTTTCTCGACGGCCTTGGCCAGCGCCGAATTCCGCGTACAAG<br>TCTGTTCTACACAAGTACACTGTGTAGCCGAGTGCCACCCTCCGAAGGAC<br>CACATAGTCAATTACCCGGCGTCACATACCACCCTCGGGGTCCAGGACAT<br>TTCCGCTACGGCGCTGTCATGGGTGCAGAAGATCACGGGAGGCGTGGGAC<br>TGGTTGTCGCTGTTGCAGCACTGATTCTAATCGTGGTGCTATGCGTGTCG<br>TTCAGCAGGCACTGATAATAGGCTGGAGCCTCGGTGGCCATGCTTCTTGC<br>CCCTTGGGCCTCCCCCCAGCCCCTCCTCCCCTTCCTGCACCCGTACCCCC<br>GTGGTCTTTGAATAAAGTCTGAGTGGGCGGC | 4 |

Example 6: Exemplary Nucleic Acids Encoding CHIKV E2 RNA Polynucleotides for Use in a RNA Vaccine The following sequences are exemplary sequences that can be used to encode CHIKV E2 RNA polynucleotides for use in a RNA vaccine:

TABLE 2

| CHIKV E2 RNA polynucleotides | | |
|---|---|---|
| Name | Sequence | SEQ ID NO |
| ChiK.secE2 HS3UPCRfree (CHIKV secreted E2 antigen): | ATGGAGACCCCAGCTCAGCTTCTGTTTCTTCTCCTTCTATGGCTGCCTGA<br>CACGACTGGACATCACCACCATCATCATAGTACAAAAGACAATTTCAATG<br>TGTACAAGGCCACCCGCCCTTATTTAGCACACTGTCCAGATTGCGGTGAG<br>GGGCACTCCTGTCACTCTCCTATCGCCTTGGAGCGGATCCGGAATGAGGC<br>GACCGATGGAACACTGAAAATCCAGGTAAGCTTGCAGATTGGCATCAAGA<br>CTGACGATAGCCATGATTGGACCAAACTACGGTATATGGATAGCCATACA<br>CCTGCCGATGCTGAACGGGCCGGTCTGCTTGTGAGAACTAGCGCTCCATG<br>CACCATCACGGGGACAATGGGACATTTTATCCTGGCTAGATGCCCAAAGG<br>GCGAAACCCTCACCGTCGGATTCACCGACTCAAGGAAAATTTCTCACACA<br>TGTACCCATCCCTTCCACCATGAGCCACCGGTGATCGGGCGCGAACGCTT<br>CCACAGCAGGCCTCAGCATGGAAAAGAACTGCCATGCTCGACCTATGTAC<br>AGTCCACCGCCGCTACCGCCGAAGAGATCGAAGTGCATATGCCTCCCGAC<br>ACACCCGACCGAACCCTAATGACACAACAATCTGGGAATGTGAAGATTAC<br>AGTCAATGGACAGACTGTGAGGTATAAGTGTAACTGCGGTGGCTCAAATG<br>AGGGCCTCACCACAACGGATAAGGTGATCAATAACTGCAAAATTGACCAG<br>TGTCACGCGGCCGTGACCAACCATAAGAACTGGCAGTACAACTCACCCTT<br>AGTGCCTAGGAACGCTGAGCTGGGAGATCGCAAGGGGAAGATACACATTC<br>CCTTCCCGTTGGCGAATGTGACCTGCCGTGTGCCAAAAGCGAGAAATCCT<br>ACCGTAACATATGGCAAAAATCAGGTGACCATGTTGCTCTACCCGGATCA<br>CCCAACTCTGCTGAGCTATCGGAATATGGGACAAGAACCCAATTACCACG<br>AGGAATGGGTTACGCACAAGAAAGAGGTGACCCTTACAGTCCCTACTGAA<br>GGTCTGGAAGTGACCTGGGGCAATAACGAGCCTTATAAGTACTGGCCCCA<br>GATGAGTACAAACGGCACCGCCCATGGACATCCACACGAGATCATTCTGT<br>ATTACTACGAACTATATCCCACAATGACTGGCAAGCCTATACCAAACCCA<br>CTTCTCGGCCTTGATAGCACATGATAATAGGCTGGAGCCTCGGTGGCCAT<br>GCTTCTTGCCCCTTGGGCCTCCCCCCAGCCCCTCCTCCCCTTCCTGCACC<br>CGTACCCCCGTGGTCTTTGAATAAAGTCTGAGTGGGCGGC | 5 |
| chikv-Brazillian-E2 (CHIKV E2 antigen-Brazilian strain): | TCAAGCTTTTGGACCCTCGTACAGAAGCTAATACGACTCACTATAGGGAA<br>ATAAGAGAGAAAAGAAGAGTAAGAAGAAATATAAGAGCCACCATGAGTAC<br>CAAGGACAACTTCAATGTCTATAAAGCCACAAGACCGTACTTAGCTCACT<br>GTCCCGACTGTGGAGAAGGGCACTCGTGCCATAGTCCCGTAGCATTAGAA<br>CGCATCAGAAATGAAGCGACAGACGGGACGCTGAAAATCCAGGTCTCCTT<br>GCAAATCGGAATAAAGACGGATGATAGCCACGATTGGACCAAGCTGCGTT<br>ACATGGACAACCACACGCCAGCGGACGCAGAGAGGGCGGGGCTATTTGTA<br>AGAACATCAGCACCGTGCACGATTACTGGAACAATGGGACACTTCATCCT<br>GACCCGATGTCCGAAAGGGGAAACTCTGACGGTGGGATTCACTGACAGTA<br>GGAAGATCAGTCACTCATGTACGCACCCATTTCACCACGACCCTCCTGTG<br>ATAGGCCGGGAGAAATTCCATTCCCGACCGCAGCACGGTAAAGAGCTGCC<br>TTGCAGCACGTACGTGCAGAGCACCGCCGCAACTACCGAGGAGATAGAGG<br>TACACATGCCCCCAGACACCCCTGATCGCACATTGATGTCACAACAGTCC<br>GGCAACGTAAAGATCACAGTTAATGGCCAGACGGTGCGGTACAAGTGTAA<br>TTGCGGTGGCTCAAATGAAGGACTAATAACTACAGACAAAGTGATTAATA<br>ACTGCAAAGTTGATCAATGTCATGCCGCGGTCACCAATCACAAAAAGTGG<br>CAGTACAACTCCCCTCTGGTCCCGCGTAATGCTGAACTTGGGGACCGAAA<br>AGGAAAAATCCACATCCCGTTTCCGCTGGCAAATGTAACATGCAGGGTGC<br>CTAAAGCAAGGAACCCCACCGTGACGTACGGAAAAACCAAGTCATCATG<br>CTACTGTATCCCGACCACCCAACACTCCTGTCCTACCGGAACATGGGAGA<br>AGAACCAAACTACCAAGAAGAGTGGGTGACGCATAAGAAGGAAGTCGTGC<br>TAACCGTGCCGACTGAAGGGCTCGAGGTCACGTGGGGTAACAACGAGCCG<br>TATAAGTATTGGCCGCAGTTATCTACAAACGGTACAGCCCATGGCCACCC<br>GCATGAGATAATTCTGTATTATTATGAGCTGTACCCTACTATGACTGTAG<br>TAGTTGTGTCAGTGGCCTCGTTCGTACTCCTGTCGATGGTGGGTGTGGCA<br>GTGGGGATGTGCATGTGTGCACGACGCAGATGCATCACACCGTACGAACT<br>GACACCAGGAGCTACCGTCCCTTTCCTGCTTAGCCTAATATGCTGCATCA<br>GAACAGCTAAAGCGTGATAATAGGCTGGAGCCTCGGTGGCCATGCTTCTT<br>GCCCCTTGGGCCTCCCCCCAGCCCCTCCTCCCCTTCCTGCACCCGTACCC<br>CCGTGGTCTTTGAATAAAGTCTGAGTGGGCGGC | 6 |

TABLE 2-continued

CHIKV E2 RNA polynucleotides

| Name | Sequence | SEQ ID NO |
|---|---|---|
| chikv-Brazillian-E2 (CHIKV E2 antigen-Brazilian strain): | TCAAGCTTTTGGACCCTCGTACAGAAGCTAATACGACTCACTATAGGGAA<br>ATAAGAGAGAAAAGAAGAGTAAGAAGAAATATAAGAGCCACCATGAGTAT<br>TAAGGACCACTTCAATGTCTATAAAGCCACAAGACCGTACCTAGCTCACT<br>GTCCCGACTGTGGAGAAGGGCACTCGTGCCATAGTCCCGTAGCGCTAGAA<br>CGCATCAGAAACGAAGCGACAGACGGGACGTTGAAAATCCAGGTTTCCTT<br>GCAAATCGGAATAAAGACGGATGATAGCCATGATTGGACCAAGCTGCGTT<br>ATATGGACAATCACATGCCAGCAGACGCAGAGCGGGCCGGGCTATTTGTA<br>AGAACGTCAGCACCGTGCACGATTACTGGAACAATGGGACACTTCATTCT<br>GGCCCGATGTCCGAAAGGAGAAACTCTGACGGTGGGGTTCACTGACGGTA<br>GGAAGATCAGTCACTCATGTACGCACCCATTTCACCATGACCCTCCTGTG<br>ATAGGCCGGGAAAAATTCCATTCCCGACCGCAGCACGGTAGGGAACTACC<br>TTGCAGCACGTACGCGCAGAGCACCGCTGCAACTGCCGAGGAGATAGAGG<br>TACACATGCCCCCAGACACCCCAGATCGCACATTAATGTCACAACAGTCC<br>GGCAATGTAAAGATCACAGTCAATAGTCAGACGGTGCGGTACAAGTGCAA<br>TTGTGGTGACTCAAGTGAAGGATTAACCACTACAGATAAAGTGATTAATA<br>ACTGCAAGGTCGATCAATGCCATGCCGCGGTCACCAATCACAAAAAATGG<br>CAGTATAACTCCCCTCTGGTCCCGCGTAATGCTGAATTCGGGGACCGGAA<br>AGGAAAAGTTCACATTCCATTTCCTCTGGCAAATGTGACATGCAGGGTGC<br>CTAAAGCAAGAAACCCCACCGTGACGTACGGAAAAAACCAAGTCATCATG<br>TTGCTGTATCCTGACCACCCAACGCTCCTGTCCTACAGGAATATGGGAGA<br>AGAACCAAACTATCAAGAAGAGTGGGTGACGCATAAGAAGGAGATCAGGT<br>TAACCGTGCCGACTGAGGGGCTCGAGGTCACGTGGGGTAACAATGAGCCG<br>TACAAGTATTGGCCGCAGTTATCCACAAACGGTACAGCCCACGGCCACCC<br>GCATGAGATAATTCTGTATTATTATGAGCTGTACCCAACTATGACTGCGG<br>TAGTTTTGTCAGTGGCCTCGTTCATACTCCTGTCGATGGTGGGTGTGGCA<br>GTGGGGATGTGCATGTGTGCACGACGCAGATGCATTACACCGTACGAACT<br>GACACCAGGAGCTACCGTCCCTTTCCTGCTTAGCCTAATATGCTGCATTA<br>GAACAGCTAAAGCGTGATAATAGGCTGGAGCCTCGGTGGCCATGCTTCTT<br>GCCCCTTGGGCCTCCCCCCAGCCCCTCCTCCCCTTCCTGCACCCGTACCC<br>CCGTGGTCTTTGAATAAAGTCTGAGTGGGCGGC | 7 |
| Chik-Strain 37997-E2 (CHIKV E2 Antigen-Strain 37997) | TCAAGCTTTTGGACCCTCGTACAGAAGCTAATACGACTCACTATAGGGAA<br>ATAAGAGAGAAAAGAAGAGTAAGAAGAAATATAAGAGCCACCATGCCATA<br>TCTAGCTCATTGTCCTGACTGCGGAGAAGGGCATTCGTGCCACAGCCCTA<br>TCGCATTGGAGCGCATCAGAAATGAAGCAACGGACGGAACGCTGAAAATC<br>CAGGTCTCTTTGCAGATCGGGATAAAGACAGATGACAGCCACGATTGGAC<br>CAAGCTGCGCTATATGGATAGCCATACGCCAGCGGACGCGGAGCGAGCCG<br>GATTGCTTGTAAGGACTTCAGCACCGTGCACGATCACCGGGACCATGGGA<br>CACTTTATTCTCGCCCGATGCCCGAAAGGAGAGACGCTGACAGTGGGATT<br>TACGGACAGCAGAAAGATCAGCCACACATGCACACACCCGTTCCATCATG<br>AACCACCTGTGATAGGTAGGGAGAGGTTCCACTCTCGACCACAACATGGT<br>AAAGAGTTACCTTGCAGCACGTACGTGCAGAGCACCGCTGCCACTGCTGA<br>GGAGATAGAGGTGCATATGCCCCCAGATACTCCTGACCGCACGCTGATGA<br>CGCAGCAGTCTGGCAACGTGAAGATCACAGTTAATGGGCAGACGGTGCGG<br>TACAAGTGCAACTGCGGTGGCTCAAACGAGGGACTGACAACCACAGACAA<br>AGTGATCAATAACTGCAAAATTGATCAGTGCCATGCTGCAGTCACTAATC<br>ACAAGAATTGGCAATACAACTCCCCTTTAGTCCCGCGCAACGCTGAACTC<br>GGGGACCGTAAAGGAAAGATCCACATCCCATTCCCATTGGCAAACGTGAC<br>TTGCAGAGTGCCAAAAGCAAGAAACCCTACAGTAACTTACGGAAAAAACC<br>AAGTCACCATGCTGCTGTATCCTGACCATCCGACACTCTTGTCTTACCGT<br>AACATGGGACAGGAACCAAATTACCACGAGGAGTGGGTGACACACAAGAA<br>GGAGGTTACCTTGACCGTGCCTACTGAGGGTCTGGAGGTCACTTGGGGCA<br>ACAACGAACCATACAAGTACTGGCCGCAGATGTCTACGAACGGTACTGCT<br>CATGGTCACCCACATGAGATAATCTTGTACTATTATGAGCTGTACCCCAC<br>TATGACTGTAGTCATTGTGTCGGTGGCCTCGTTCGTGCTTCTGTCGATGG<br>TGGGCACAGCAGTGGGAATGTGTGTGTGCGCACGGCGCAGATGCATTACA<br>CCATATGAATTAACACCAGGAGCCACTGTTCCCTTCCTGCTCAGCCTGCT<br>ATGCTGCTGATAATAGGCTGGAGCCTCGGTGGCCATGCTTCTTGCCCCTT<br>GGGCCTCCCCCCAGCCCCTCCTCCCCTTCCTGCACCCGTACCCCCGTGGT<br>CTTTGAATAAAGTCTGAGTGGGCGGC | 8 |

Example 7: Exemplary Nucleic Acids Encoding CHIKV E1-E2 RNA Polynucleotides for Use in a RNA Vaccine The following sequences are exemplary sequences that can be used to encode CHIKV E1-E2 RNA polynucleotides for use in a RNA vaccine:

TABLE 3

CHIKV E1-E2 RNA polynucleotides

| Name | Sequence | SEQ ID NO |
|---|---|---|
| chikv-Brazillian-E2-E1 (CHIKV E1-E2 Antigen-Brazilian strain): | TCAAGCTTTTGGACCCTCGTACAGAAGCTAATACGACTCACTATAGGGAA<br>ATAAGAGAGAAAAGAAGAGTAAGAAGAAATATAAGAGCCACCATGAGTAC<br>CAAGGACAACTTCAATGTCTATAAAGCCACAAGACCGTACTTAGCTCACT<br>GTCCCGACTGTGGAGAAGGGCACTCGTGCCATAGTCCCGTAGCATTAGAA<br>CGCATCAGAAATGAAGCGACAGACGGGACGCTGAAAATCCAGGTCTCCTT<br>GCAAATCGGAATAAAGACGGATGATAGCCACGATTGGACCAAGCTGCGTT<br>ACATGGACAACCACACGCCAGCGGACGCAGAGAGGGCGGGGCTATTTGTA<br>AGAACATCAGCACCGTGCACGATTACTGGAACAATGGGACACTTCATCCT<br>GACCCGATGTCCGAAAGGGGAAACTCTGACGGTGGGATTCACTGACAGTA<br>GGAAGATCAGTCACTCATGTACGCACCCATTTCACCACGACCCTCCTGTG<br>ATAGGCCGGGAGAAATTCCATTCCCGACCGCAGCACGGTAAAGAGCTGCC<br>TTGCAGCACGTACGTGCAGAGCACCGCCGCAACTACCGAGGAGATAGAGG<br>TACACATGCCCCCAGACACCCCTGATCGCACATTGATGTCACAACAGTCC<br>GGCAACGTAAAGATCACAGTTAATGGCCAGACGGTGCGGTACAAGTGTAA<br>TTGCGGTGGCTCAAATGAAGGACTAATAACTACAGACAAAGTGATTAATA<br>ACTGCAAAGTTGATCAATGTCATGCCGCGGTCACCAATCACAAAAAGTGG<br>CAGTACAACTCCCCTCTGGTCCCGCGTAATGCTGAACTTGGGGACCGAAA<br>AGGAAAAATCCACATCCCGTTTCCGCTGGCAAATGTAACATGCAGGGTGC<br>CTAAAGCAAGGAACCCCACCGTGACGTACGGAAAAAACCAAGTCATCATG<br>CTACTGTATCCCGACCACCCAACACTCCTGTCCTACCGGAACATGGGAGA<br>AGAACCAAACTACCAAGAAGAGTGGGTGACGCATAAGAAGGAAGTCGTGC<br>TAACCGTGCCGACTGAAGGGCTCGAGGTCACGTGGGGTAACAACGAGCCG<br>TATAAGTATTGGCCGCAGTTATCTACAAACGGTACAGCCCATGGCCACCC<br>GCATGAGATAATTCTGTATTATTATGAGCTGTACCCTACTATGACTGTAG<br>TAGTTGTGTCAGTGGCCTCGTTCGTACTCCTGTCGATGGTGGGTGTGGCA<br>GTGGGGATGTGCATGTGTGCACGACGCAGATGCATCACACCGTACGAACT<br>GACACCAGGAGCTACCGTCCCTTTCCTGCTTAGCCTAATATGCTGCATCA<br>GAACAGCTAAAGCGTACGAACACGTAACAGTGATCCCGAACACGGTGGGA<br>GTACCGTATAAGACTCTAGTCAATAGACCGGGCTACAGTCCCATGGTATT<br>GGAGATGGAACTACTGTCAGTCACTTTGGAGCCAACGCTATCGCTTGATT<br>ACATCACGTGCGAGTACAAAACCGTTATCCCGTCTCCGTACGTGAAATGC<br>TGCGGTACAGCAGAGTGCAAGGACAAAAACCTACCTGACTACAGCTGTAA<br>GGTCTTCACCGGCGTCTACCCATTTATGTGGGGCGGAGCCTACTGCTTCT<br>GCGACGCTGAAAACACGCAATTGAGCGAAGCACACGTGGAGAAGTCCGAA<br>TCATGCAAAACAGAATTTGCATCAGCATACAGGGCTCATACCGCATCCGC<br>ATCAGCTAAGCTCCGCGTCCTTTACCAAGGAAATAACATCACTGTAACTG<br>CCTATGCTAACGGCGACCATGCCGTCACAGTTAAGGACGCCAAATTCATT<br>GTGGGGCCAATGTCTTCAGCCTGGACACCTTTCGACAACAAAATTGTGGT<br>GTACAAAGGTGACGTCTATAACATGGACTACCCGCCCTTTGGCGCAGGAA<br>GACCAGGACAATTTGGCGATATCCAAAGTCGCACACCTGAGAGTAAAGAC<br>GTCTATGCTAATACACAACTGGTACTGCAGAGACCGGCTGCGGGTACGGT<br>ACATGTGCCATACTCTCAGGCACCATCTGGCTTTAAGTATTGGCTAAAAG<br>AACGAGGGGCGTCGCTGCAGCACACAGCACCATTTGGCTGCCAAATAGCA<br>ACAAACCCGGTAAGAGCGGTGAATTGCGCCGTAGGGAACATGCCCATCTC<br>CATCGACATACCGGATGCGGCCTTCATTAGGGTCGTCGACGCGCCCTCTT<br>TAACGGACATGTCGTGCGAGGTACCAGCCTGCACCCATTCCTCAGATTTC<br>GGGGGCGTCGCCATTATTAAATATGCAGCCAGCAAGAAAGGCAAGTGTGC<br>GGTGCATTCGATGACCAACGCCGTCACAATTCGGGAAGCTGAGATAGAAG<br>TTGAAGGGAATTCTCAGCTGCAAATCTCTTTCTCGACGGCCTTGGCCAGC<br>GCCGAATTCCGCGTACAAGTCTGTTCTACACAAGTACACTGTGTAGCCGA<br>GTGCCACCCTCCGAAGGACCACATAGTCAATTACCCGGCGTCACATACCA<br>CCCTCGGGGTCCAGGACATTTCCGCTACGGCGCTGTCATGGGTGCAGAAG<br>ATCACGGGAGGCGTGGGACTGGTTGTCGCTGTTGCAGCACTGATTCTAAT<br>CGTGGTGCTATGCGTGTCGTTCAGCAGGCACTGATAATAGGCTGGAGCCT<br>CGGTGGCCATGCTTCTTGCCCCTTGGGCCTCCCCCCAGCCCCTCCTCCCC<br>TTCCTGCACCCGTACCCCCGTGGTCTTTGAATAAAGTCTGAGTGGGCGGC | 9 |
| chikv-Brazillian-E2-E1 (CHIKV E1-E2 Antigen-Brazilian strain): | TCAAGCTTTTGGACCCTCGTACAGAAGCTAATACGACTCACTATAGGGAA<br>ATAAGAGAGAAAAGAAGAGTAAGAAGAAATATAAGAGCCACCATGAGTAT<br>TAAGGACCACTTCAATGTCTATAAAGCCACAAGACCGTACCTAGCTCACT<br>GTCCCGACTGTGGAGAAGGGCACTCGTGCCATAGTCCCGTAGCGCTAGAA<br>CGCATCAGAAACGAAGCGACAGACGGGACGTTGAAAATCCAGGTTTCCTT<br>GCAAATCGGAATAAAGACGGATGATAGCCATGATTGGACCAAGCTGCGTT<br>ATATGGACAATCACATGCCAGCAGACGCAGAGCGGGCCGGGCTATTTGTA<br>AGAACGTCAGCACCGTGCACGATTACTGGAACAATGGGACACTTCATTCT<br>GGCCCGATGTCCGAAAGGAGAAACTCTGACGGTGGGGTTCACTGACGGTA | 10 |

TABLE 3-continued

CHIKV E1-E2 RNA polynucleotides

| Name | Sequence | SEQ ID NO |
|---|---|---|
| | GGAAGATCAGTCACTCATGTACGCACCCATTTCACCATGACCCTCCTGTG | |
| | ATAGGCCGGGAAAAATTCCATTCCCGACCGCAGCACGGTAGGGAACTACC | |
| | TTGCAGCACGTACGCGCAGAGCACCGCTGCAACTGCCGAGGAGATAGAGG | |
| | TACACATGCCCCCAGACACCCCAGATCGCACATTAATGTCACAACAGTCC | |
| | GGCAATGTAAAGATCACAGTCAATAGTCAGACGGTGCGGTACAAGTGCAA | |
| | TTGTGGTGACTCAAGTGAAGGATTAACCACTACAGATAAAGTGATTAATA | |
| | ACTGCAAGGTCGATCAATGCCATGCCGCGGTCACCAATCACAAAAAATGG | |
| | CAGTATAACTCCCCTCTGGTCCCGCGTAATGCTGAATTCGGGGACCGGAA | |
| | AGGAAAAGTTCACATTCCATTTCCTCTGGCAAATGTGACATGCAGGGTGC | |
| | CTAAAGCAAGAAACCCCACCGTGACGTACGGAAAAAACCAAGTCATCATG | |
| | TTGCTGTATCCTGACCACCCAACGCTCCTGTCCTACAGGAATATGGGAGA | |
| | AGAACCAAACTATCAAGAAGAGTGGGTGACGCATAAGAAGGAGATCAGGT | |
| | TAACCGTGCCGACTGAGGGGCTCGAGGTCACGTGGGGTAACAATGAGCCG | |
| | TACAAGTATTGGCCGCAGTTATCCACAAACGGTACAGCCCACGGCCACCC | |
| | GCATGAGATAATTCTGTATTATTATGAGCTGTACCCAACTATGACTGCGG | |
| | TAGTTTTGTCAGTGGCCTCGTTCATACTCCTGTCGATGGTGGGTGTGGCA | |
| | GTGGGGATGTGCATGTGTGCACGACGCAGATGCATTACACCGTACGAACT | |
| | GACACCAGGAGCTACCGTCCCTTTCCTGCTTAGCCTAATATGCTGCATTA | |
| | GAACAGCTAAAGCGTACGAACACGTAACAGTGATCCCGAACACGGTGGGA | |
| | GTACCGTATAAGACTCTAGTCAACAGACCGGGCTACAGCCCCATGGTATT | |
| | GGAGATGGAGCTTCTGTCTGTCACCTTGGAACCAACGCTATCGCTTGATT | |
| | ACATCACGTGCGAGTATAAAACCGTTATCCCGTCTCCGTACGTGAAATGC | |
| | TGCGGTACAGCAGAGTGTAAGGACAAGAGCCTACCTGATTACAGCTGTAA | |
| | GGTCTTCACCGGCGTCTACCCATTCATGTGGGGCGGCGCCTACTGCTTCT | |
| | GCGACACCGAAAATACGCAATTGAGCGAAGCACATGTGGAGAAGTCCGAA | |
| | TCATGCAAAACAGAATTTGCATCAGCATACAGGGCTCATACCGCATCCGC | |
| | ATCAGCTAAGCTCCGCGTCCTTTACCAAGGAAATAATATCACTGTGGCTG | |
| | CTTATGCAAACGGCGACCATGCCGTCACAGTTAAGGACGCTAAATTCATA | |
| | GTGGGGCCAATGTCTTCAGCCTGGACACCTTTCGACAATAAAATCGTGGT | |
| | GTACAAAGGCGACGTCTACAACATGGACTACCCGCCCTTCGGCGCAGGAA | |
| | GACCAGGACAATTTGGCGACATCCAAAGTCGCACGCCTGAGAGCGAAGAC | |
| | GTCTATGCTAATACACAACTGGTACTGCAGAGACCGTCCGCGGGTACGGT | |
| | GCACGTGCCGTACTCTCAGGCACCATCTGGCTTCAAGTATTGGCTAAAAG | |
| | AACGAGGGGCGTCGCTGCAGCACACAGCACCATTTGGCTGTCAAATAGCA | |
| | ACAAACCCGGTAAGAGCGATGAACTGCGCCGTAGGGAACATGCCTATCTC | |
| | CATCGACATACCGGACGCGGCCTTTACCAGGGTCGTCGACGCGCCATCTT | |
| | TAACGGACATGTCGTGTGAGGTATCAGCCTGCACCCATTCCTCAGACTTT | |
| | GGGGGCGTAGCCATCATTAAATATGCAGCCAGTAAGAAAGGCAAGTGTGC | |
| | AGTGCACTCGATGACTAACGCCGTCACTATTCGGGAAGCTGAAATAGAAG | |
| | TAGAAGGGAACTCTCAGTTGCAAATCTCTTTTTCGACGGCCCTAGCCAGC | |
| | GCCGAATTTCGCGTACAAGTCTGTTCTACACAAGTACACTGTGCAGCCGA | |
| | GTGCCATCCACCGAAAGACCATATAGTCAATTACCCGGCGTCACACACCA | |
| | CCCTCGGGGTCCAAGACATTTCCGCTACGGCGATGTCATGGGTGCAGAAG | |
| | ATCACGGGAGGTGTGGGACTGGTTGTCGCTGTTGCAGCACTGATCCTAAT | |
| | CGTGGTGCTATGCGTGTCGTTTAGCAGGCACATGAGTATTAAGGACCACT | |
| | TCAATGTCTATAAAGCCACAAGACCGTACCTAGCTCACTGTCCCGACTGT | |
| | GGAGAAGGGCACTCGTGCCATAGTCCCGTAGCGCTAGAACGCATCAGAAA | |
| | CGAAGCGACAGACGGGACGTTGAAAATCCAGGTTTCCTTGCAAATCGGAA | |
| | TAAAGACGGATGATAGCCATGATTGGACCAAGCTGCGTTATATGGACAAT | |
| | CACATGCCAGCAGACGCAGAGCGGGCCGGGCTATTTGTAAGAACGTCAGC | |
| | ACCGTGCACGATTACTGGAACAATGGGACACTTCATTCTGGCCCGATGTC | |
| | CGAAAGGAGAAACTCTGACGGTGGGGTTCACTGACGGTAGGAAGATCAGT | |
| | CACTCATGTACGCACCCATTTCACCATGACCCTCCTGTGATAGGCCGGGA | |
| | AAAATTCCATTCCCGACCGCAGCACGGTAGGGAACTACCTTGCAGCACGT | |
| | ACGCGCAGAGCACCGCTGCAACTGCCGAGGAGATAGAGGTACACATGCCC | |
| | CCAGACACCCCAGATCGCACATTAATGTCACAACAGTCCGGCAATGTAAA | |
| | GATCACAGTCAATAGTCAGACGGTGCGGTACAAGTGCAATTGTGGTGACT | |
| | CAAGTGAAGGATTAACCACTACAGATAAAGTGATTAATAACTGCAAGGTC | |
| | GATCAATGCCATGCCGCGGTCACCAATCACAAAAAATGGCAGTATAACTC | |
| | CCCTCTGGTCCCGCGTAATGCTGAATTCGGGGACCGGAAAGGAAAAGTTC | |
| | ACATTCCATTTCCTCTGGCAAATGTGACATGCAGGGTGCCTAAAGCAAGA | |
| | AACCCCACCGTGACGTACGGAAAAAACCAAGTCATCATGTTGCTGTATCC | |
| | TGACCACCCAACGCTCCTGTCCTACAGGAATATGGGAGAAGAACCAAACT | |
| | ATCAAGAAGAGTGGGTGACGCATAAGAAGGAGATCAGGTTAACCGTGCCG | |
| | ACTGAGGGGCTCGAGGTCACGTGGGGTAACAATGAGCCGTACAAGTATTG | |
| | GCCGCAGTTATCCACAAACGGTACAGCCCACGGCCACCCGCATGAGATAA | |
| | TTCTGTATTATTATGAGCTGTACCCAACTATGACTGCGGTAGTTTTGTCA | |
| | GTGGCCTCGTTCATACTCCTGTCGATGGTGGGTGTGGCAGTGGGGATGTG | |
| | CATGTGTGCACGACGCAGATGCATTACACCGTACGAACTGACACCAGGAG | |
| | CTACCGTCCCTTTCCTGCTTAGCCTAATATGCTGCATTAGAACAGCTAAA | |
| | GCGTACGAACACGTAACAGTGATCCCGAACACGGTGGGAGTACCGTATAA | |
| | GACTCTAGTCAACAGACCGGGCTACAGCCCCATGGTATTGGAGATGGAGC | |
| | TTCTGTCTGTCACCTTGGAACCAACGCTATCGCTTGATTACATCACGTGC | |
| | GAGTATAAAACCGTTATCCCGTCTCCGTACGTGAAATGCTGCGGTACAGC | |
| | AGAGTGTAAGGACAAGAGCCTACCTGATTACAGCTGTAAGGTCTTCACCG | |

TABLE 3-continued

CHIKV E1-E2 RNA polynucleotides

| Name | Sequence | SEQ ID NO |
|---|---|---|
| | GCGTCTACCCATTCATGTGGGGCGGCGCCTACTGCTTCTGCGACACCGAA<br>AATACGCAATTGAGCGAAGCACATGTGGAGAAGTCCGAATCATGCAAAAC<br>AGAATTTGCATCAGCATACAGGGCTCATACCGCATCCGCATCAGCTAAGC<br>TCCGCGTCCTTTACCAAGGAAATAATATCACTGTGGCTGCTTATGCAAAC<br>GGCGACCATGCCGTCACAGTTAAGGACGCTAAATTCATAGTGGGGCCAAT<br>GTCTTCAGCCTGGACACCTTTCGACAATAAAATCGTGGTGTACAAAGGCG<br>ACGTCTACAACATGGACTACCCGCCCTTCGGCGCAGGAAGACCAGGACAA<br>TTTGGCGACATCCAAAGTCGCACGCCTGAGAGCGAAGACGTCTATGCTAA<br>TACACAACTGGTACTGCAGAGACCGTCCGCGGGTACGGTGCACGTGCCGT<br>ACTCTCAGGCACCATCTGGCTTCAAGTATTGGCTAAAAGAACGAGGGGCG<br>TCGCTGCAGCACACAGCACCATTTGGCTGTCAAATAGCAACAAACCCGGT<br>AAGAGCGATGAACTGCGCCGTAGGGAACATGCCTATCTCCATCGACATAC<br>CGGACGCGGCCTTTACCAGGGTCGTCGACGCGCCATCTTTAACGGACATG<br>TCGTGTGAGGTATCAGCCTGCACCCATTCCTCAGACTTTGGGGGCGTAGC<br>CATCATTAAATATGCAGCCAGTAAGAAAGGCAAGTGTGCAGTGCACTCGA<br>TGACTAACGCCGTCACTATTCGGGAAGCTGAAATAGAAGTAGAAGGGAAC<br>TCTCAGTTGCAAATCTCTTTTTCGACGGCCCTAGCCAGCGCCGAATTTCG<br>CGTACAAGTCTGTTCTACACAAGTACACTGTGCAGCCGAGTGCCATCCAC<br>CGAAAGACCATATAGTCAATTACCCGGCGTCACACACCACCCTCGGGGTC<br>CAAGACATTTCCGCTACGGCGATGTCATGGGTGCAGAAGATCACGGGAGG<br>TGTGGGACTGGTTGTCGCTGTTGCAGCACTGATCCTAATCGTGGTGCTAT<br>GCGTGTCGTTTAGCAGGCACTGATAATAGGCTGGAGCCTCGGTGGCCATG<br>CTTCTTGCCCCTTGGGCCTCCCCCCAGCCCCTCCTCCCCTTCCTGCACCC<br>GTACCCCCGTGGTCTTTGAATAAAGTCTGAGTGGGCGGC | |
| Chik-Strain 37997-E2-E1 (CHIKV E1-E2 Antigen-Strain 37997): | TCAAGCTTTTGGACCCTCGTACAGAAGCTAATACGACTCACTATAGGGAA<br>ATAAGAGAGAAAAGAAGAGTAAGAAGAAATATAAGAGCCACCATGCCATA<br>TCTAGCTCATTGTCCTGACTGCGGAGAAGGGCATTCGTGCCACAGCCCTA<br>TCGCATTGGAGCGCATCAGAAATGAAGCAACGGACGGAACGCTGAAAATC<br>CAGGTCTCTTTGCAGATCGGGATAAAGACAGATGACAGCCACGATTGGAC<br>CAAGCTGCGCTATATGGATAGCCATACGCCAGCGGACGCGGAGCGAGCCG<br>GATTGCTTGTAAGGACTTCAGCACCGTGCACGATCACCGGGACCATGGGA<br>CACTTTATTCTCGCCCGATGCCCGAAAGGAGAGACGCTGACAGTGGGATT<br>TACGGACAGCAGAAAGATCAGCCACACATGCACACACCCGTTCCATCATG<br>AACCACCTGTGATAGGTAGGGAGAGGTTCCACTCTCGACCACAACATGGT<br>AAAGAGTTACCTTGCAGCACGTACGTGCAGAGCACCGCTGCCACTGCTGA<br>GGAGATAGAGGTGCATATGCCCCCAGATACTCCTGACCGCACGCTGATGA<br>CGCAGCAGTCTGGCAACGTGAAGATCACAGTTAATGGGCAGACGGTGCGG<br>TACAAGTGCAACTGCGGTGGCTCAAACGAGGGACTGACAACCACAGACAA<br>AGTGATCAATAACTGCAAAATTGATCAGTGCCATGCTGCAGTCACTAATC<br>ACAAGAATTGGCAATACAACTCCCCTTTAGTCCCGCGCAACGCTGAACTC<br>GGGGACCGTAAAGGAAAGATCCACATCCCATTCCCATTGGCAAACGTGAC<br>TTGCAGAGTGCCAAAAGCAAGAAACCCTACAGTAACTTACGGAAAAAACC<br>AAGTCACCATGCTGCTGTATCCTGACCATCCGACACTCTTGTCTTACCGT<br>AACATGGGACAGGAACCAAATTACCACGAGGAGTGGGTGACACACAAGAA<br>GGAGGTTACCTTGACCGTGCCTACTGAGGGTCTGGAGGTCACTTGGGGCA<br>ACAACGAACCATACAAGTACTGGCCGCAGATGTCTACGAACGGTACTGCT<br>CATGGTCACCCACATGAGATAATCTTGTACTATTATGAGCTGTACCCCAC<br>TATGACTGTAGTCATTGTGTCGGTGGCCTCGTTCGTGCTTCTGTCGATGG<br>TGGGCACAGCAGTGGGAATGTGTGTGTGCGCACGGCGCAGATGCATTACA<br>CCATATGAATTAACACCAGGAGCCACTGTTCCCTTCCTGCTCAGCCTGCT<br>ATGCTGCCTATGGAACGAACAGCAGCCCCTGTTCTGGTTGCAGGCTCTTA<br>TCCCGCTGGCCGCCTTGATCGTCCTGTGCAACTGTCTGAAACTCTTGCCA<br>TGCTGCTGTAAGACCCTGGCTTTTTTAGCCGTAATGAGCATCGGTGCCCA<br>CACTGTGAGCGCGTACGAACACGTAACAGTGATCCCGAACACGGTGGGAG<br>TACCGTATAAGACTCTTGTCAACAGACCGGGTTACAGCCCCATGGTGTTG<br>GAGATGGAGCTACAATCAGTCACCTTGGAACCAACACTGTCACTTGACTA<br>CATCACGTGCGAGTACAAAACTGTCATCCCCTCCCCGTACGTGAAGTGCT<br>GTGGTACAGCAGAGTGCAAGGACAAGAGCCTACCAGACTACAGCTGCAAG<br>GTCTTTACTGGAGTCTACCCATTTATGTGGGGCGGCGCCTACTGCTTTTG<br>CGACGCCGAAAATACGCAATTGAGCGAGGCACATGTAGAGAAATCTGAAT<br>CTTGCAAAACAGAGTTTGCATCGGCCTACAGAGCCCACACCGCATCGGCG<br>TCGGCGAAGCTCCGCGTCCTTTACCAAGGAAACAACATTACCGTAGCTGC<br>CTACGCTAACGGTGACCATGCCGTCACAGTAAAGGACGCCAAGTTTGTCG<br>TGGGCCCAATGTCCTCCGCCTGGACACCTTTTGACAACAAAATCGTGGTG<br>TACAAAGGCGACGTCTACAACATGGACTACCCACCTTTTGGCGCAGGAAG<br>ACCAGGACAATTTGGTGACATTCAAAGTCGTACACCGGAAAGTAAAGACG<br>TTTATGCCAACACTCAGTTGGTACTACAGAGGCCAGCAGCAGGCACGGTA<br>CATGTACCATACTCTCAGGCACCATCTGGCTTCAAGTATTGGCTGAAGGA<br>ACGAGGAGCATCGCTACAGCACACGGCACCGTTCGGTTGCCAGATTGCGA<br>CAAACCCGGTAAGAGCTGTAAATTGCGCTGTGGGGAACATACCAATTTCC<br>ATCGACATACCGGATGCGGCCTTTACTAGGGTTGTCGATGCACCCTCTGT<br>AACGGACATGTCATGCGAAGTACCAGCCTGCACTCACTCCTCCGACTTTG<br>GGGGCGTCGCCATCATCAAATACACAGCTAGCAAGAAAGGTAAATGTGCA<br>GTACATTCGATGACCAACGCCGTTACCATTCGAGAAGCCGACGTAGAAGT | 11 |

TABLE 3-continued

| CHIKV E1-E2 RNA polynucleotides | | |
|---|---|---|
| Name | Sequence | SEQ ID NO |
| | AGAGGGGAACTCCCAGCTGCAAATATCCTTCTCAACAGCCCTGGCAAGCG<br>CCGAGTTTCGCGTGCAAGTGTGCTCCACACAAGTACACTGCGCAGCCGCA<br>TGCCACCCTCCAAAGGACCACATAGTCAATTACCCAGCATCACACACCAC<br>CCTTGGGGTCCAGGATATATCCACAACGGCAATGTCTTGGGTGCAGAAGA<br>TTACGGGAGGAGTAGGATTAATTGTTGCTGTTGCTGCCTTAATTTTAATT<br>GTGGTGCTATGCGTGTCGTTTAGCAGGCACTAATGATAATAGGCTGGAGC<br>CTCGGTGGCCATGCTTCTTGCCCCTTGGGCCTCCCCCCAGCCCCTCCTCC<br>CCTTCCTGCACCCGTACCCCCGTGGTCTTTGAATAAAGTCTGAGTGGGCG<br>GC | |

Example 8: Exemplary Nucleic Acids Encoding CHIKV C-E3-E2-6K-E1 RNA Polynucleotides for Use in a RNA Vaccine The following sequence is an exemplary sequence that can be used to encode an CHIKV, DENV and/or ZIKV RNA polynucleotide C-E3-E2-6K-E1 for use in a RNA vaccine:

TABLE 4

| CHIKV RNA polynucleotide C-E3-E2-6K-E1 | | |
|---|---|---|
| Name | Sequence | SEQ ID NO |
| Chik.C-E3-E2-6K-E1_HS3UPCRfree (C-E3-E2-6K-E1 Antigen) | TCAAGCTTTTGGACCCTCGTACAGAAGCTAATACGACTCACTATAGGGAA<br>ATAAGAGAGAAAAGAAGAGTAAGAAGAAATATAAGAGCCACCATGGAGTT<br>TATCCCTACGCAGACGTTCTATAATCGGAGGTACCAGCCCAGGCCTTGGG<br>CCCCCCGCCCTACAATCCAAGTGATAAGACCACGTCCCAGGCCGCAGAGA<br>CAAGCCGGCCAATTGGCGCAACTCATCAGCGCAGTTAACAAGTTGACCAT<br>GCGAGCGGTTCCTCAGCAGAAGCCGAGGCGGAACCGGAAGAATAAGAAAC<br>AACGCCAAAAGAAACAGGCGCCGCAGAACGACCCTAAACAGAAGAAACAA<br>CCTCCCCAGAAAAAGCCAGCTCAGAAGAAGAAGAAGCCTGGACGCCGTGA<br>AAGAATGTGCATGAAAATCGAAAATGATTGCATCTTTGAGGTGAAGCACG<br>AGGGCAAAGTGATGGGGTACGCATGCCTGGTGGGCGATAAGGTCATGAAG<br>CCAGCACATGTGAAGGGGACAATCGATAATGCTGATCTGGCCAAGCTAGC<br>TTTTAAACGTAGCTCCAAATACGATCTTGAGTGTGCCCAGATACCTGTGC<br>ACATGAAATCTGATGCAAGCAAGTTCACACACGAGAAGCCTGAGGGCTAT<br>TATAACTGGCATCATGGTGCGGTTCAGTACTCCGGCGGCCGATTTACCAT<br>TCCTACAGGGGCAGGAAAGCCGGGCGATTCGGGGAGACCCATTTTCGACA<br>ACAAAGGCCGCGTGGTAGCTATCGTGCTCGGTGGGGCTAATGAGGGTGCA<br>CGTACTGCACTTAGCGTGGTTACCTGGAATAAGGACATTGTCACAAAGAT<br>TACACCGGAGGGAGCAGAGGAATGGAGCCTGGCACTGCCCGTTCTGTGCC<br>TGCTGGCCAACACCACTTTCCCATGTAGTCAACCCCCTTGCACTCCCTGC<br>TGCTATGAGAAAGAGCCTGAGAGCACGTTACGTATGCTGGAAGATAATGT<br>CATGAGGCCCGGGTACTATCAACTGCTCAAGGCTAGTCTGACATGCTCGC<br>CCCACAGGCAGCGCAGGTCCACGAAAGATAACTTCAACGTTTACAAGGCT<br>ACTAGGCCTTATTTGGCCCACTGTCCCGATTGCGGAGAGGGACATTCTTG<br>TCATAGTCCTATTGCCTTGGAGCGAATCCGCAACGAGGCCACTGATGGAA<br>CCCTTAAGATTCAAGTATCTTTGCAGATTGGCATTAAGACAGATGATTCC<br>CATGACTGGACAAAGCTTCGGTACATGGACTCACACACGCCTGCAGATGC<br>TGAAAGGGCAGGGCTCTTGGTCAGGACCTCGGCCCCTTGTACAATTACCG<br>GGACCATGGGCCACTTCATCCTTGCACGCTGCCCTAAGGGGGAGACGCTG<br>ACGGTGGGCTTTACTGACTCGCGTAAGATCTCACACACATGTACACACCC<br>TTTCCACCACGAACCTCCAGTCATAGGGAGAGAGAGATTTCACTCTCGCC<br>CACAGCATGGCAAAGAGCTGCCATGCTCCACATATGTCCAGAGCACTGCT<br>GCTACCGCTGAAGAAATTGAGGTTCACATGCCACCCGATACACCAGACCG<br>TACTCTGATGACCCAACAGAGCGGCAACGTGAAGATTACCGTAAATGGAC<br>AGACCGTGAGATATAAGTGCAACTGTGGTGGCTCCAATGAGGGCTTAACA<br>ACAACGGATAAGGTGATTAACAATTGCAAAATAGATCAGTGCCATGCCGC<br>AGTGACCAATCACAAGAATTGGCAATACAACTCACCCCTAGTGCCGAGGA<br>ACGCAGAACTAGGCGACAGGAAAGGGAAAATCCATATACCCTTCCCCCTA<br>GCAAATGTGACCTGCCGAGTGCCCAAGGCCAGAAACCCCACGGTTACTTA<br>CGGCAAGAACCAGGTGACGATGCTTTTGTACCCAGACCATCCCACCTTGC<br>TCTCTTATAGAAACATGGGACAGGAGCCTAACTATCATGAGGAGTGGGTG<br>ACACACAAGAAAGAAGTCACCCTTACCGTGCCTACCGAAGGGCTTGAAGT<br>CACCTGGGGCAACAACGAGCCTTACAAGTATTGGCCACAGATGTCCACAA<br>ACGGAACAGCCCACGGCCACCCGCACGAGATCATACTGTATTACTATGAG<br>CTTTATCCCACAATGACTGTCGTAATTGTGAGCGTTGCCAGCTTCGTGTT<br>GCTTTCAATGGTTGGCACTGCCGTGGGGATGTGCGTGTGTGCTAGGCGCC<br>GCTGTATAACTCCTTATGAACTAACTCCAGGCGCCACCGTTCCTTTCCTG | 12 |

TABLE 4-continued

CHIKV RNA polynucleotide C-E3-E2-6K-E1

| Name | Sequence | SEQ ID NO |
|---|---|---|
| | CTCTCACTACTGTGTTGTGTGCGCACAACAAAGGCTGCCACCTACTACGA<br>AGCCGCCGCCTACTTATGGAATGAACAGCAGCCTCTCTTTTGGTTACAGG<br>CGCTGATTCCTCTTGCTGCCCTGATCGTGCTATGCAACTGCCTCAAGCTG<br>CTGCCCTGTTGTTGCAAGACCCTAGCTTTTCTCGCCGTGATGAGCATCGG<br>GGCACATACAGTGTCCGCCTATGAGCACGTCACCGTTATCCCGAACACCG<br>TCGGTGTGCCATATAAGACGTTAGTCAATCGACCCGGCTACTCTCCAATG<br>GTGCTGGAAATGGAACTCCAGAGTGTGACACTGGAGCCAACCTTATCCCT<br>CGATTATATTACCTGCGAATACAAGACCGTCATCCCTTCACCCTATGTCA<br>AGTGCTGTGGGACCGCTGAATGCAAAGACAAGAGCTTGCCTGATTACAGT<br>TGCAAGGTCTTCACAGGTGTGTACCCCTTCATGTGGGGGGGAGCTTATTG<br>CTTTTGTGATGCTGAGAACACCCAACTGAGCGAGGCTCACGTCGAGAAAT<br>CTGAGTCTTGCAAGACCGAGTTTGCCTCAGCTTACAGGGCCCACACGGCC<br>AGCGCATCCGCCAAATTGAGGGTACTCTACCAGGGTAATAATATCACCGT<br>TGCCGCATATGCAAACGGCGATCACGCCGTGACTGTCAAGGATGCCAAGT<br>TCGTTGTGGGCCCCATGTCTAGCGCTTGGACACCGTTCGATAATAAGATC<br>GTCGTGTACAAAGGGGACGTGTATAATATGGACTACCCACCTTTCGGGGC<br>CGGCCGACCGGGACAGTTCGGGGATATTCAGAGCCGCACACCCGAATCTA<br>AAGATGTTTACGCCAATACTCAGCTCGTCCTGCAGAGGCCCGCCGCTGGT<br>ACAGTTCACGTTCCTTACTCACAGGCACCCTCTGGGTTTAAGTATTGGCT<br>GAAAGAACGAGGTGCCAGCTTGCAGCATACAGCGCCTTTCGGATGCCAGA<br>TTGCCACTAACCCCGTACGGGCTGTCAACTGCGCGGTCGGCAATATTCCC<br>ATTAGCATTGATATCCCGGACGCAGCTTTCACCAGGGTTGTGGACGCCCC<br>GAGCGTCACCGACATGAGTTGTGAGGTGCCAGCCTGCACGCATAGCAGTG<br>ATTTCGGCGGCGTCGCCATCATTAAATATACCGCAAGCAAGAAAGGCAAG<br>TGCGCCGTCCACTCGATGACTAACGCCGTCACAATTCGGGAAGCCGATGT<br>TGAGGTCGAAGGCAACTCCCAGCTGCAGATCAGCTTCTCTACTGCTCTTG<br>CAAGCGCCGAGTTTCGAGTCCAGGTCTGCAGTACGCAGGTGCATTGTGCA<br>GCTGCCTGCCATCCACCCAAAGATCATATTGTGAATTATCCGGCGTCACA<br>TACCACACTGGGGGTCCAGGATATTAGTACAACGGCGATGTCCTGGGTGC<br>AGAAAATTACGGGAGGAGTGGGCTTAATTGTTGCCGTGGCGGCCCTGATC<br>CTGATCGTTGTGCTGTGTGTTAGCTTCTCTAGGCATGACTATAAAGATGA<br>CGATGACAAATGATAATAGGCTGGAGCCTCGGTGGCCATGCTTCTTGCCC<br>CTTGGGCCTCCCCCCAGCCCCTCCTCCCCTTCCTGCACCCGTACCCCCGT<br>GGTCTTTGAATAAAGTCTGAGTGGGCGGC | |
| CHIKV C-E3-<br>E2-6K-E1 | TCAAGCTTTTGGACCCTCGTACAGAAGCTAATACGACTCACTATAGGGAA<br>ATAAGAGAGAAAAGAAGAGTAAGAAGAAATATAAGAGCCACCATGGAGTT<br>TATCCCTACGCAGACGTTCTATAATCGGAGGTACCAGCCCAGGCCTTGGG<br>CCCCCCGCCCTACAATCCAAGTGATAAGACCACGTCCCAGGCCGCAGAGA<br>CAAGCCGGCCAATTGGCGCAACTCATCAGCGCAGTTAACAAGTTGACCAT<br>GCGAGCGGTTCCTCAGCAGAAGCCGAGGCGGAACCGGAAGAATAAGAAAC<br>AACGCCAAAAGAAACAGGCGCCGCAGAACGACCCTAAACAGAAGAAACAA<br>CCTCCCCAGAAAAAGCCAGCTCAGAAGAAGAAGAAGCCTGGACGCCGTGA<br>AAGAATGTGCATGAAAATCGAAAATGATTGCATCTTTGAGGTGAAGCACG<br>AGGGCAAAGTGATGGGGTACGCATGCCTGGTGGGCGATAAGGTCATGAAG<br>CCAGCACATGTGAAGGGGACAATCGATAATGCTGATCTGGCCAAGCTAGC<br>TTTTAAACGTAGCTCCAAATACGATCTTGAGTGTGCCCAGATACCTGTGC<br>ACATGAAATCTGATGCAAGCAAGTTCACACACGAGAAGCCTGAGGGCTAT<br>TATAACTGGCATCATGGTGCGGTTCAGTACTCCGGCGGCCGATTTACCAT<br>TCCTACAGGGGCAGGAAAGCCGGGCGATTCGGGGAGACCCATTTTCGACA<br>ACAAAGGCCGCGTGGTAGCTATCGTGCTCGGTGGGGCTAATGAGGGTGCA<br>CGTACTGCACTTAGCGTGGTTACCTGGAATAAGGACATTGTCACAAAGAT<br>TACACCGGAGGGAGCAGAGGAATGGAGCCTGGCACTGCCCGTTCTGTGCC<br>TGCTGGCCAACACCACTTTCCCATGTAGTCAACCCCCTTGCACTCCCTGC<br>TGCTATGAGAAAGAGCCTGAGAGCACGTTACGTATGCTGGAAGATAATGT<br>CATGAGGCCCGGGTACTATCAACTGCTCAAGGCTAGTCTGACATGCTCGC<br>CCCACAGGCAGCGCAGGTCCACGAAAGATAACTTCAACGTTTACAAGGCT<br>ACTAGGCCTTATTTGGCCCACTGTCCCGATTGCGGAGAGGGACATTCTTG<br>TCATAGTCCTATTGCCTTGGAGCGAATCCGCAACGAGGCCACTGATGGAA<br>CCCTTAAGATTCAAGTATCTTTGCAGATTGGCATTAAGACAGATGATTCC<br>CATGACTGGACAAAGCTTCGGTACATGGACTCACACACGCCTGCAGATGC<br>TGAAAGGGCAGGGCTCTTGGTCAGGACCTCGGCCCCTTGTACAATTACCG<br>GGACCATGGGCCACTTCATCCTTGCACGCTGCCCTAAGGGGGAGACGCTG<br>ACGGTGGGCTTTACTGACTCGCGTAAGATCTCACACACATGTACACACCC<br>TTTCCACCACGAACCTCCAGTCATAGGGAGAGAGAGATTTCACTCTCGCC<br>CACAGCATGGCAAAGAGCTGCCATGCTCCACATATGTCCAGAGCACTGCT<br>GCTACCGCTGAAGAAATTGAGGTTCACATGCCACCCGATACACCAGACCG<br>TACTCTGATGACCCAACAGAGCGGCAACGTGAAGATTACCGTAAATGGAC<br>AGACCGTGAGATATAAGTGCAACTGTGGTGGCTCCAATGAGGGCTTAACA<br>ACAACGGATAAGGTGATTAACAATTGCAAAATAGATCAGTGCCATGCCGC<br>AGTGACCAATCACAAGAATTGGCAATACAACTCACCCCTAGTGCCGAGGA<br>ACGCAGAACTAGGCGACAGGAAAGGAAAATCCATATACCCTTCCCCCTA<br>GCAAATGTGACCTGCCGAGTGCCCAAGGCCAGAAACCCCACGGTTACTTA<br>CGGCAAGAACCAGGTGACGATGCTTTTGTACCCAGACCATCCCACCTTGC<br>TCTCTTATAGAAACATGGGACAGGAGCCTAACTATCATGAGGAGTGGGTG | 13 |

TABLE 4-continued

| CHIKV RNA polynucleotide C-E3-E2-6K-E1 | | |
|---|---|---|
| Name | Sequence | SEQ ID NO |
| | ACACACAAGAAAGAAGTCACCCTTACCGTGCCTACCGAAGGGCTTGAAGT CACCTGGGGCAACAACGAGCCTTACAAGTATTGGCCACAGATGTCCACAA ACGGAACAGCCCACGGCCACCCGCACGAGATCATACTGTATTACTATGAG CTTTATCCCACAATGACTGTCGTAATTGTGAGCGTTGCCAGCTTCGTGTT GCTTTCAATGGTTGGCACTGCCGTGGGGATGTGCGTGTGTGCTAGGCGCC GCTGTATAACTCCTTATGAACTAACTCCAGGCGCCACCGTTCCTTTCCTG CTCTCACTACTGTGTTGTGTGCGCACAACAAAGGCTGCCACCTACTACGA AGCCGCCGCCTACTTATGGAATGAACAGCAGCCTCTCTTTTGGTTACAGG CGCTGATTCCTCTTGCTGCCCTGATCGTGCTATGCAACTGCCTCAAGCTG CTGCCCTGTTGTTGCAAGACCCTAGCTTTTCTCGCCGTGATGAGCATCGG GGCACATACAGTGTCCGCCTATGAGCACGTCACCGTTATCCCGAACACCG TCGGTGTGCCATATAAGACGTTAGTCAATCGACCCGGCTACTCTCCAATG GTGCTGGAAATGGAACTCCAGAGTGTGACACTGGAGCCAACCTTATCCCT CGATTATATTACCTGCGAATACAAGACCGTCATCCCTTCACCCTATGTCA AGTGCTGTGGGACCGCTGAATGCAAAGACAAGAGCTTGCCTGATTACAGT TGCAAGGTCTTCACAGGTGTGTACCCCTTCATGTGGGGGGGAGCTTATTG CTTTTGTGATGCTGAGAACACCCAACTGAGCGAGGCTCACGTCGAGAAAT CTGAGTCTTGCAAGACCGAGTTTGCCTCAGCTTACAGGGCCCACACGGCC AGCGCATCCGCCAAATTGAGGGTACTCTACCAGGGTAATAATATCACCGT TGCCGCATATGCAAACGGCGATCACGCCGTGACTGTCAAGGATGCCAAGT TCGTTGTGGGCCCCATGTCTAGCGCTTGGACACCGTTCGATAATAAGATC GTCGTGTACAAAGGGGACGTGTATAATATGGACTACCCACCTTTCGGGGC CGGCCGACCGGGACAGTTCGGGGATATTCAGAGCCGCACACCCGAATCTA AAGATGTTTACGCCAATACTCAGCTCGTCCTGCAGAGGCCCGCCGCTGGT ACAGTTCACGTTCCTTACTCACAGGCACCCTCTGGGTTTAAGTATTGGCT GAAAGAACGAGGTGCCAGCTTGCAGCATACAGCGCCTTTCGGATGCCAGA TTGCCACTAACCCCGTACGGGCTGTCAACTGCGCGGTCGGCAATATTCCC ATTAGCATTGATATCCCGGACGCAGCTTTCACCAGGGTTGTGGACGCCCC GAGCGTCACCGACATGAGTTGTGAGGTGCCAGCCTGCACGCATAGCAGTG ATTTCGGCGGCGTCGCCATCATTAAATATACCGCAAGCAAGAAAGGCAAG TGCGCCGTCCACTCGATGACTAACGCCGTCACAATTCGGGAAGCCGATGT TGAGGTCGAAGGCAACTCCCAGCTGCAGATCAGCTTCTCTACTGCTCTTG CAAGCGCCGAGTTTCGAGTCCAGGTCTGCAGTACGCAGGTGCATTGTGCA GCTGCCTGCCATCCACCCAAAGATCATATTGTGAATTATCCGGCGTCACA TACCACACTGGGGGTCCAGGATATTAGTACAACGGCGATGTCCTGGGTGC AGAAAATTACGGGAGGAGTGGGCTTAATTGTTGCCGTGGCGGCCCTGATC CTGATCGTTGTGCTGTGTGTTAGCTTCTCTAGGCATTGATAATAGGCTGG AGCCTCGGTGGCCATGCTTCTTGCCCCTTGGGCCTCCCCCCAGCCCCTCC TCCCCTTCCTGCACCCGTACCCCCGTGGTCTTTGAATAAAGTCTGAGTGG GCGGC | |
| CHIKV C-E3-E2-6K-E1 | SSFWTLVQKLIRLTIGKERKEEEEIEPPWSLSLRRRSIIGGTSPGLGPPA LQSKDHVPGRRDKPANWRNSSAQLTSPCERFLSRSRGGTGRIRNNAKRNR RRRTTLNRRNNLPRKSQLRRRRSLDAVKECAKSKMIASLRSTRAKWGTHA WWAIRSSQHMRGQSIMLIWPSLLNVAPNTILSVPRYLCTNLMQASSHTRS LRAIITGIMVRFSTPAADLPFLQGQESRAIRGDPFSTTKAAWLSCSVGLM RVHVLHLAWLPGIRTLSQRLHRREQRNGAWHCPFCACWPTPLSHVVNPLA LPAAMRKSLRARYVCWKIMSGPGTINCSRLVHARPTGSAGPRKITSTFTR LLGLIWPTVPIAERDILVIVLLPWSESATRPLMEPLRFKYLCRLALRQMI PMTGQSFGTWTHTRLQMLKGQGSWSGPRPLVQLPGPWATSSLHAALRGRR RWALLTRVRSHTHVHTLSTTNLQSGERDFTLAHSMAKSCHAPHMSRALLL PLKKLRFTCHPIHQTVLPNRAATRLPMDRPDISATVVAPMRAQQRIRLTI AKISAMPQPITRIGNTTHPCRGTQNATGKGKSIYPSPQMPAECPRPETPR LLTARTRRCFCTQTIPPCSLIETWDRSLTIMRSGHTRKKSPLPCLPKGLK SPGATTSLTSIGHRCPQTEQPTATRTRSYCITMSFIPQLSLALPASCCFQ WLALPWGCACVLGAAVLLMNLQAPPFLSCSHYCVVCAQQRLPPTTKPPPT YGMNSSLSFGYRRFLLLPSCYATASSCCPVVARPLFSPASGHIQCPPMST SPLSRTPSVCHIRRSIDPATLQWCWKWNSRVHWSQPYPSIILPANTRPSS LHPMSSAVGPLNAKTRACLITVARSSQVCTPSCGGELIAFVMLRTPNARL TSRNLSLARPSLPQLTGPTRPAHPPNGYSTRVIISPLPHMQTAITPLSRM PSSLWAPCLALGHRSIIRSSCTKGTCIIWTTHLSGPADRDSSGIFRAAHP NLKMFTPILSSSCRGPPLVQFTFLTHRHPLGLSIGKNEVPACSIQRLSDA RLPLTPYGLSTARSAIFPLALISRTQLSPGLWTPRASPTVVRCQPARIAV ISAASPSLNIPQARKASAPSTRLTPSQFGKPMLRSKATPSCRSASLLLLQ APSFESRSAVRRCIVQLPAIHPKIILIIRRHIPHWGSRILVQRRCPGCRK LREEWALLPWRPSSLCCVLASLGIDNRLEPRWPCFLPLGPPPSPSSPSCT RTPVVFESLSGR | 14 |

Figure 2:
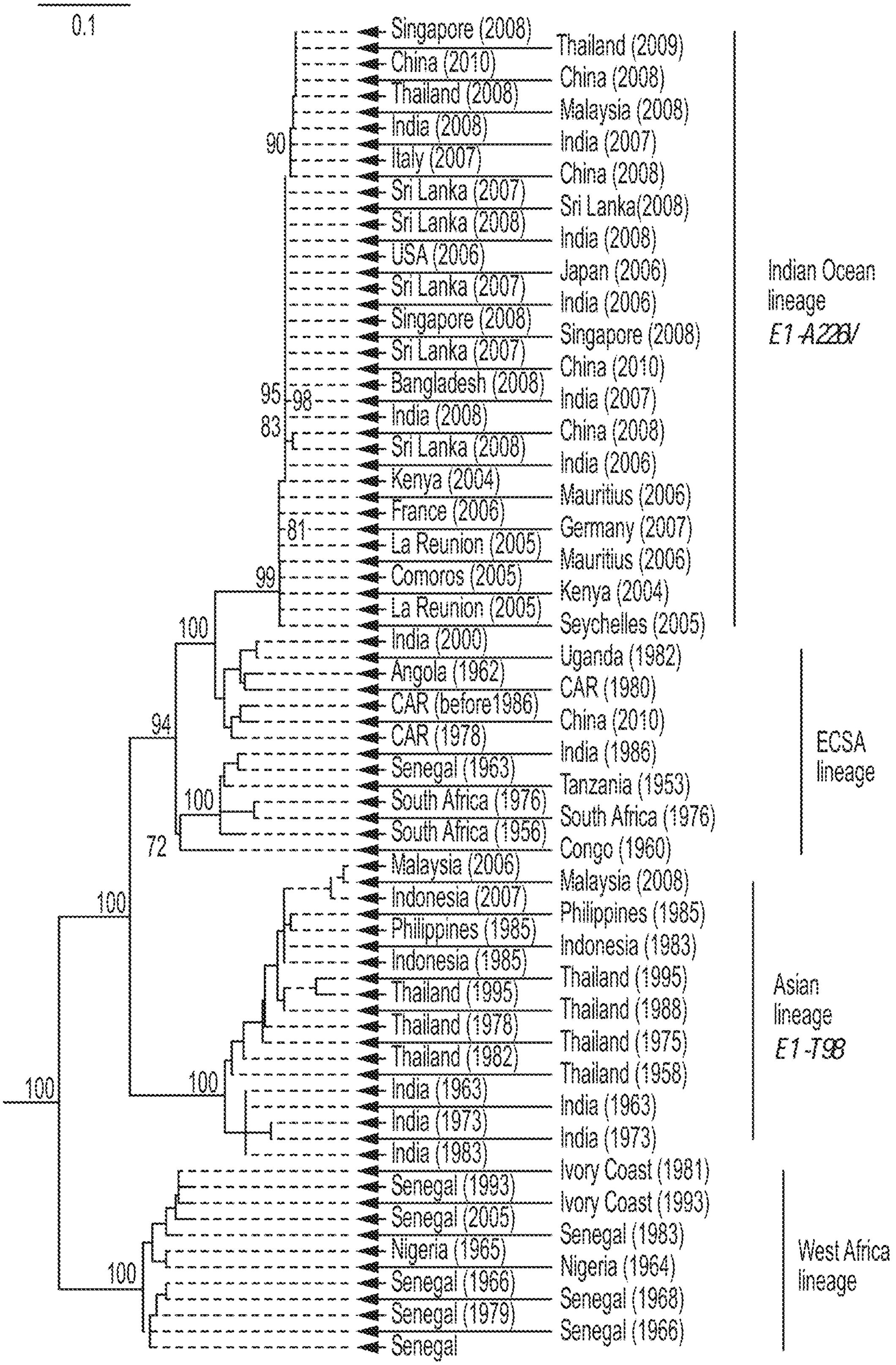
FIG. 2 shows a phylogenetic tree of chikungunya virus strains derived from complete concatenated open reading frames for the nonstructural and structural polyproteins. E1 amino acid substitutions that facilitated (Indian Ocean lineage) or prevented (Asian lineage) adaptation to *Aedes albopictus* are shown on the right. CAR: Central African republic; ECSA: East/Central/South Africa.

FIG. 2 shows a phylogenetic tree of chikungunya virus strains derived from complete concatenated open reading frames for the nonstructural and structural polyproteins. E1 amino acid substitutions that facilitated (Indian Ocean lineage) or prevented (Asian lineage) adaptation to *Aedes albopictus* are shown on the right. CAR: Central African republic; ECSA: East/Central/South Africa

Example 9: Protocol to Determine Efficacy of mRNA-Encoded Chikungunya Antigen Candidates Against CHIKV Chikungunya has a polycistronic genome and different antigens, based on the Chikungunya structural protein, are possible. There are membrane-bound and secreted forms of E1 and E2, as well as the full length polyprotein antigen, which retains the protein's native conformation. Additionally, the different CHIKV genotypes can also yield different antigens.

The efficacy of Chik candidate vaccines in AG129 mice against challenge with a lethal dose of CHIKV strain 181/25 was investigated. A129 mice, which lack IFN α/β receptor signaling, injected intradermally in the footpad with $10^4$ PFU of CHIKV 181/25 virus have a 100% survival rate post-injection. In contrast, AG129 mice, which lack IFN α/β and γ receptor signaling, injected intradermally in the footpad with $10^4$ PFU of CHIKV 181/25 virus do not survive past day 5 post-injection. The tested vaccines included: MC3-LNP formulated mRNA encoded CHIKV-E1, MC3-LNP formulated mRNA encoded CHIKV-E2, and MC3-LNP formulated mRNA encoded CHIKV-E1/E2/E3/C. Fifteen groups of five AG129 mice were vaccinated via intradermal (ID) or intramuscular (IM) injection with either 2 μg or 10 μg of the candidate vaccine. The vaccines were given to AG129 mice as single or two doses (second dose provided 28 days after the first dose). The positive control group was vaccinated via intranasal instillation (20 μL volume) with heat-inactivated CHIKV. Phosphate-buffered saline (PBS) was used as a negative control.

On day 56, mice were challenged with $1\times10^4$ PFU of CHIKV via ID injection in 50 μL volume and monitored for 10 days for weight loss, morbidity, and mortality. Mice that displayed severe illness, defined as >30% weight loss, a health score of 6 or above, extreme lethargy, and/or paralysis were euthanized. Notably, mice "vaccinated" with heat-inactivated CHIKV (positive control group) became morbid and were euthanized following the second dose of HI-CHIKV (they were not included in the challenge portion of the study).

In addition, individual samples were tested for reactivity in a semi-quantitative ELISA for mouse IgG against either Chikungunya-specific E1 (groups 1-4), Chikungunya-specific E2 (groups 5-8), or Chikungunya-specific E1 and E2 proteins (groups 9-15).

The health status is scored as indicated in the following Table 5:

TABLE 5

| Health Status | | | | | |
|---|---|---|---|---|---|
| SCORE | INITIALS | DESCRIPTION | APPEARANCE | MOBILITY | ATTITUDE |
| 1 | H | Healthy | Smooth Coat. Bright Eyes. | Active, Scurrying, Burrowing | Alert |
| 2 | SR | Slightly Ruffled | Slightly Ruffled coat (usually only around head and neck) | Active, Scurrying, Burrowing | Alert |
| 3 | R | Ruffled | Ruffled Coat throughout body. A "wet" appearance. | Active, Scurrying, Burrowing | Alert |
| 4 | S | Sick | Very Ruffled coat. Slightly closed, inset eyes. | Walking, but no scurrying. | Mildly Lethargic |
| 5 | VS | Very Sick (Euthanize) | Very Ruffled Coat. Closed, inset eyes. | Slow to no movement. Will return to upright position if put on its side. | Extremely Lethargic |
| 6 | E | Euthanize | Very ruffled Coat. Closed, inset eyes. Moribund requiring humane euthanasia. | No movement or Uncontrollable, spastic movements. Will NOT return to upright position if put on its side. | Completely Unaware or in Noticeable Distress |
| 7 | D | Deceased | — | — | — |

Example 10: Efficacy of Chikungunya E1 Antigen mRNA Vaccine Candidate

Figure 4A:
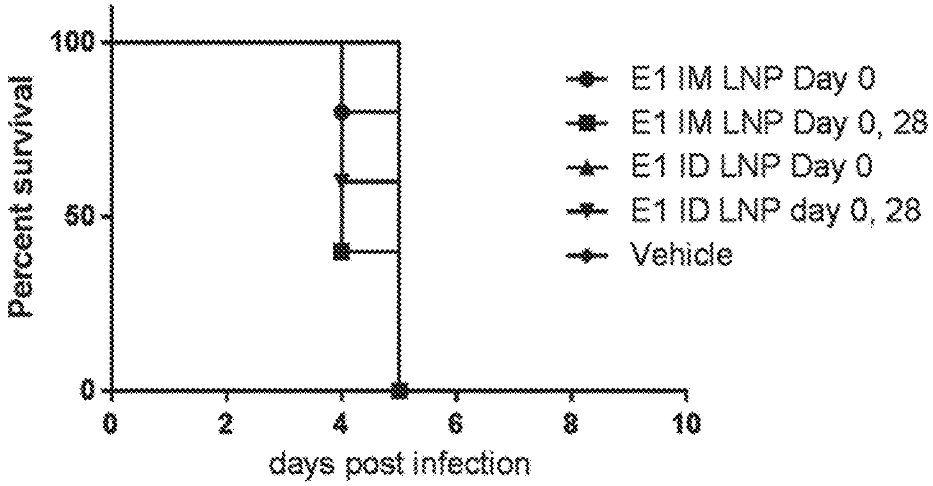
FIG. 4A is a graph showing the survival rates of AG129 mice vaccinated with a single 2 μg dose or two 2 μg doses of Chikungunya E1 antigen administered either intramuscularly or intradermally.
Figure 4B:
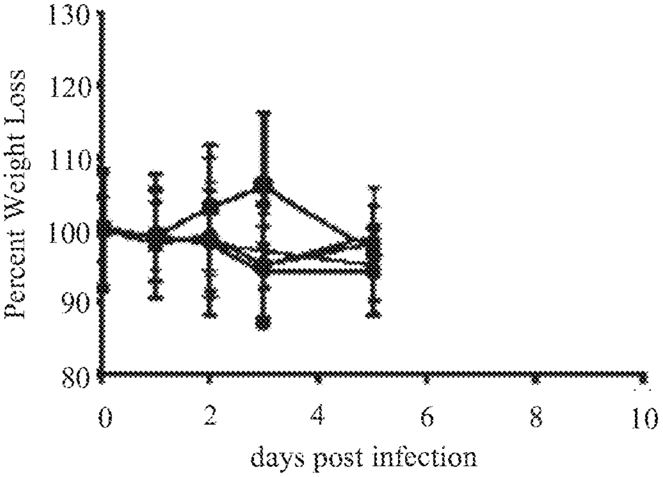
FIG. 4B is a graph showing the percent weight loss of AG129 mice vaccinated with a single 2 μg dose or two 2 μg doses of Chikungunya E1 antigen administered either intramuscularly or intradermally.
Figure 4C:
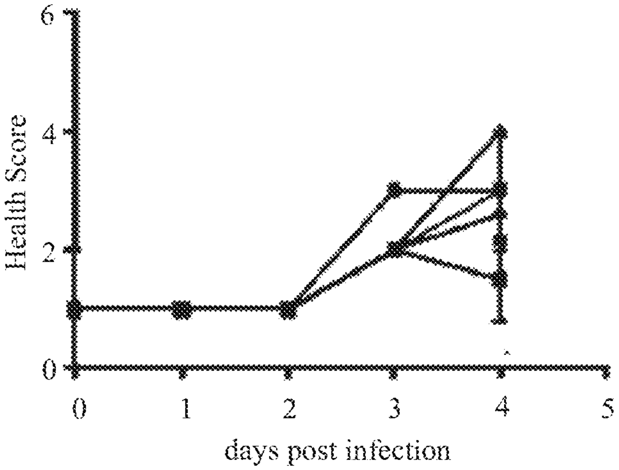
FIG. 4C is a graph showing the health scores of AG129 mice vaccinated with a single 2 μg dose or two 2 μg doses of Chikungunya E1 antigen administered either intramuscularly or intradermally.
Figure 8A:
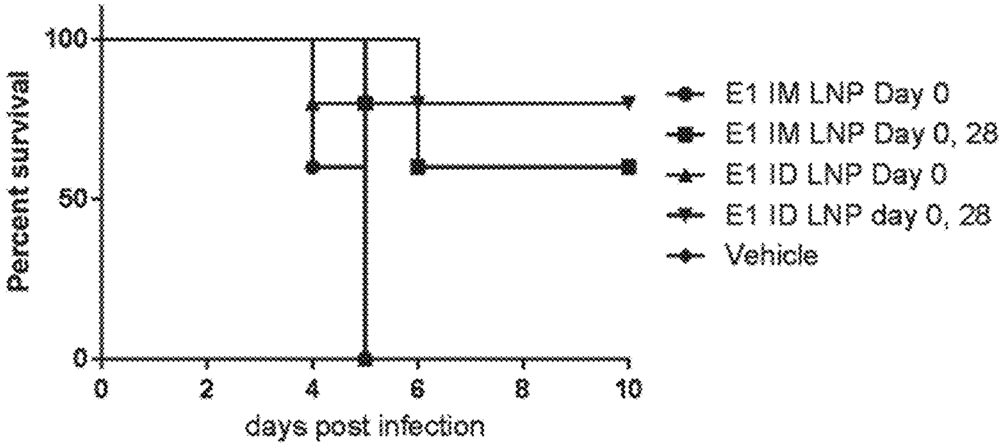
FIG. 8A is a graph showing the survival rates of AG129 mice vaccinated with a single 10 μg dose or two 10 μg doses of Chikungunya E1 antigen administered either intramuscularly or intradermally.
Figure 8B:
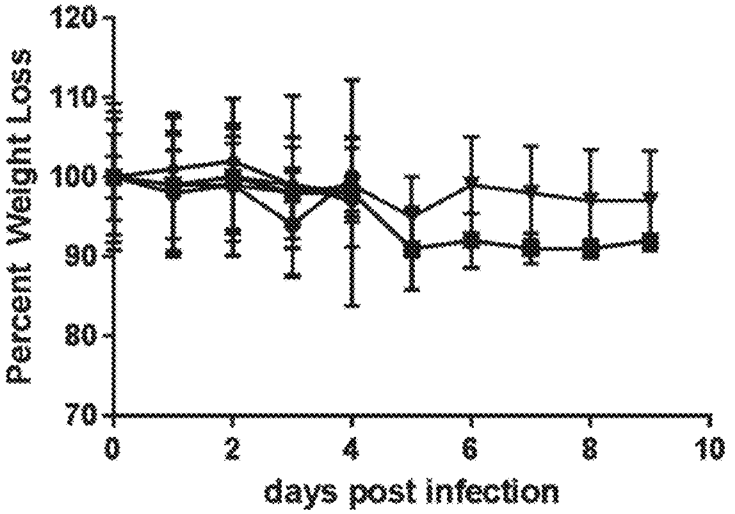
FIG. 8B is a graph showing the percent weight loss of AG129 mice vaccinated with a single 10 μg dose or two 10 μg doses of Chikungunya E1 antigen administered either intramuscularly or intradermally.
Figure 8C:
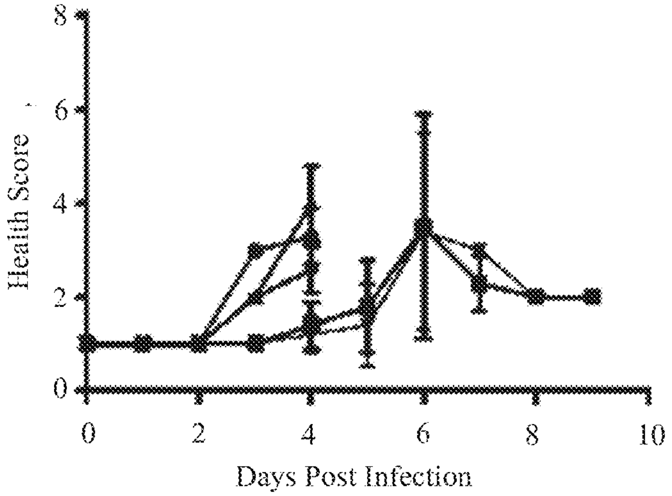
FIG. 8C is a graph showing the health scores of AG129 mice vaccinated with a single 10 μg dose or two 10 μg doses of Chikungunya E1 antigen administered either intramuscularly or intradermally.

AG129 mice (n=5 per group) were vaccinated with 2 μg or 10 μg of MC-3-LNP formulated mRNA encoding CHIKV E1. The AG129 mice were vaccinated on either Day 0 or Days 0 and 28 via IM or ID delivery. On Day 56 following final vaccination all mice were challenged with a lethal dose of CHIKV. The survival curve, percent weight loss, and health status of the mice vaccinated with 2 μg CHIKV E1 mRNA are shown in FIGS. 4A-C. The survival results are tabulated in Table 6 below. The survival curve, percent weight loss, and health status of the mice vaccinated with 10 μg CHIKV E1 mRNA are shown in FIGS. 8A-C. The survival results are tabulated in Table 7 below.

TABLE 6

Survival of mice vaccinated with Chikungunya E1 antigen mRNA - 2 μg dose

| days post infection | E1 IM LNP Day 0 | E1 IM LNP Day 0, 28 | E1 ID LNP Day 0 | E1 ID LNP Day 0, 28 | Vehicle |
|---|---|---|---|---|---|
| 0.000 | 100.000 | 100.000 | 100.000 | 100.000 | 100.000 |
| 4.000 | 80.000 | 40.000 | 40.000 | 60.000 | |
| 5.000 | 0.000 | 0.000 | 0.000 | 0.000 | 0.000 |

TABLE 7

| Survival of mice vaccinated with Chikungunya E1 antigen mRNA - 10 μg dose | | | | | |
|---|---|---|---|---|---|
| days post infection | E1 IM LNP Day 0 | E1 IM LNP Day 0, 28 | E1 ID LNP Day 0 | E1 ID LNP Day 0, 28 | Vehicle |
| 0.000 | 100.000 | 100.000 | 100.000 | 100.000 | 100.000 |
| 4.000 | 60.000 | | 80.000 | | |
| 5.000 | 0.000 | 80.000 | 0.000 | | 0.000 |
| 6.000 | | 60.000 | | 80.000 | |
| 10.000 | | 60.000 | | 80.000 | |

As shown in Table 6, the 2 μg dose of CHIKV E1 mRNA vaccine gave no protection post-CHIKV infection challenge when administered via IM or ID with either a single dose or two doses. Likewise, the single dose of 10 μg CHIKV E1 vaccine provided little to no protection when administered via IM or ID. However, as indicated in Table 7, the 10 μg dose of CHIKV E1 mRNA vaccine provided 60% protection post-CHIKV challenge when administered via IM using two doses and provided 80% protection post-CHIKV challenge when administered via ID using two doses.

In all experiments, the negative control mice had a ~0% survival rate, as did the positive control mice (heat-inactivated CHIKV), which died before CHIKV challenge. Some mice died during the vaccination period.

Example 11: Efficacy of Chikungunya E2 Antigen mRNA Vaccine Candidate

Figure 5A:
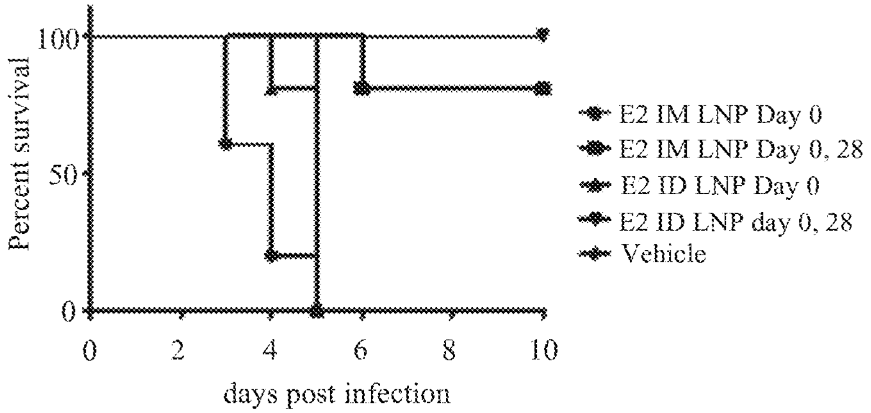
FIG. 5A is a graph showing the survival rates of AG129 mice vaccinated with a single 2 μg dose or two 2 μg doses of Chikungunya E2 antigen administered either intramuscularly or intradermally.
Figure 5B:
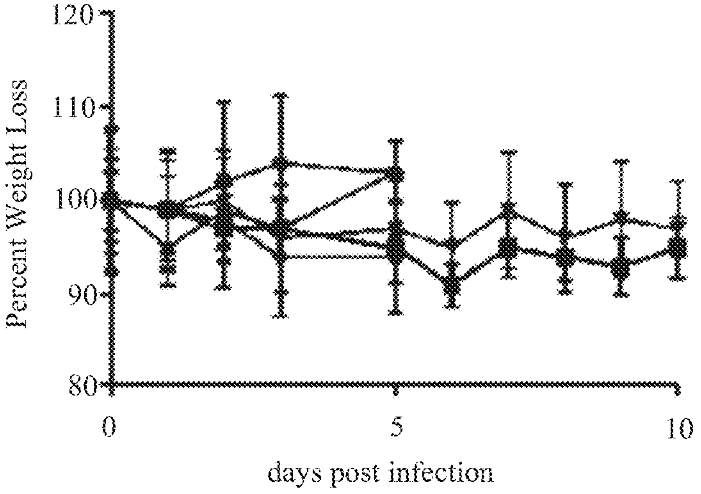
FIG. 5B is a graph showing the percent weight loss of AG129 mice vaccinated with a single 2 μg dose or two 2 μg doses of Chikungunya E2 antigen administered either intramuscularly or intradermally.
Figure 5C:
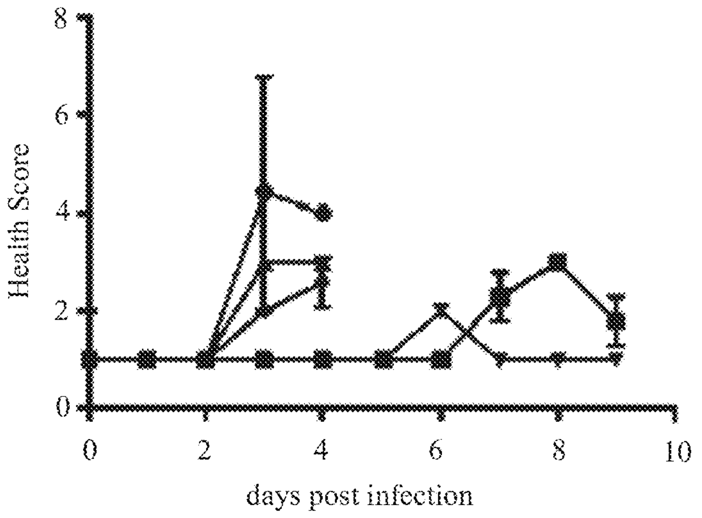
FIG. 5C is a graph showing the health scores of AG129 mice vaccinated with a single 2 μg dose or two 2 μg doses of Chikungunya E2 antigen administered either intramuscularly or intradermally.
Figure 9A:
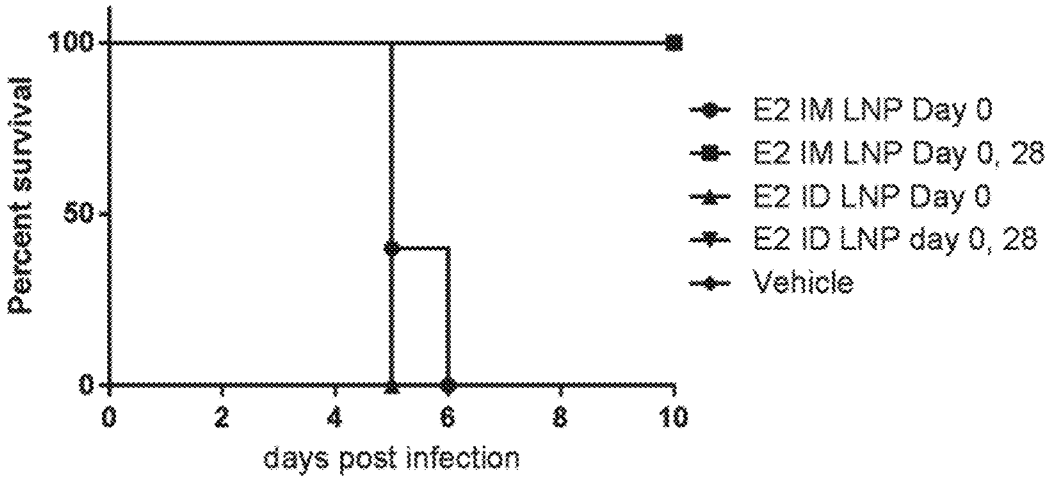
FIG. 9A is a graph showing the survival rates of AG129 mice vaccinated with a single 10 μg dose or two 10 μg doses of Chikungunya E2 antigen administered either intramuscularly or intradermally.
Figure 9B:
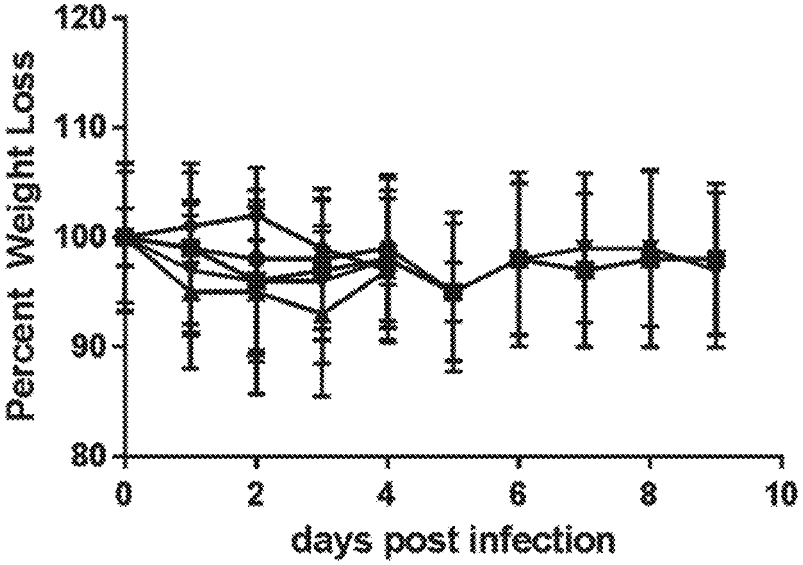
FIG. 9B is a graph showing the percent weight loss of AG129 mice vaccinated with a single 10 μg dose or two 10 μg doses of Chikungunya E2 antigen administered either intramuscularly or intradermally.
Figure 9C:
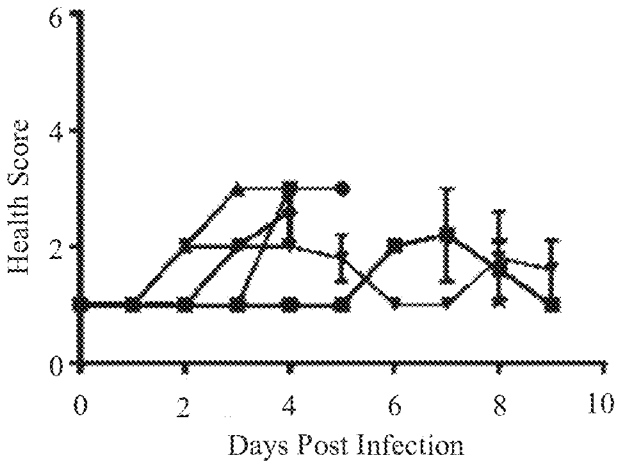
FIG. 9C is a graph showing the health scores of AG129 mice vaccinated with a single 10 μg dose or two 10 μg doses of Chikungunya E2 antigen administered either intramuscularly or intradermally.

AG129 mice (n=5 per group) were vaccinated with 2 μg or 10 μg of MC-3-LNP formulated mRNA encoding CHIKV E2. The mice were vaccinated on either Day 0 or Days 0 and 28 via IM or ID delivery. On Day 56 following final vaccination all mice were challenged with a lethal dose of CHIKV. The survival curve, percent weight loss, and health status of the mice vaccinated with 2 μg CHIKV E2 mRNA are shown in FIGS. 5A-C. The survival results are tabulated in Table 8 below. The survival curve, percent weight loss, and health status of the mice vaccinated with 10 μg CHIKV E2 mRNA are shown in FIGS. 9A-C. The survival results are tabulated in Table 9 below.

TABLE 8

| Survival of mice vaccinated with Chikungunya E2 antigen mRNA - 2 μg dose | | | | | |
|---|---|---|---|---|---|
| days post infection | E1 IM LNP Day 0 | E1 IM LNP Day 0, 28 | E1 ID LNP Day 0 | E1 ID LNP Day 0, 28 | Vehicle |
| 0.000 | 100.000 | 100.000 | 100.000 | 100.000 | 100.000 |
| 3.000 | 60.000 | | | | |
| 4.000 | 20.000 | | 80.000 | | 0.000 |
| 5.000 | 0.000 | | 0.000 | | 0.000 |
| 6.000 | | 80.000 | | | |
| 10.000 | | 80.000 | | 100.000 | |

TABLE 9

| Survival of mice vaccinated with Chikungunya E2 antigen mRNA - 10 μg dose | | | | | |
|---|---|---|---|---|---|
| days post infection | E2 IM LNP Day 0 | E2 IM LNP Day 0, 28 | E2 ID LNP Day 0 | E2 ID LNP Day 0, 28 | Vehicle |
| 0.000 | 100.000 | 100.000 | 100.000 | 100.000 | 100.000 |
| 5.000 | 40.000 | | 0.000 | | 0.000 |
| 6.000 | 0.000 | | | | |
| 10.000 | | 100.000 | | 100.000 | |

As shown in Table 8, the 2 μg dose of CHIKV E2 mRNA vaccine gave no protection post-CHIKV infection challenge when administered via IM or ID in a single dose. However, when provided in two doses, the 2 μg dose of CHIKV E2 mRNA vaccine provided 80% protection when administered via IM and 100% protection when administered via ID post-CHIKV challenge. As indicated in Table 9, the 10 μg dose of CHIKV E2 mRNA mouse provided no protection post-CHIKV challenge when administered via IM or ID in a single dose. However, administration of CHIKV E2 mRNA via IM or ID using two doses provided 100% protection post-CHIKV challenge.

In all experiments, the negative control mice had a ~0% survival rate, as did the positive control mice (heat-inactivated CHIKV) which died prior to CHIKV challenge. Some mice died during the vaccination period.

Figure 6A:
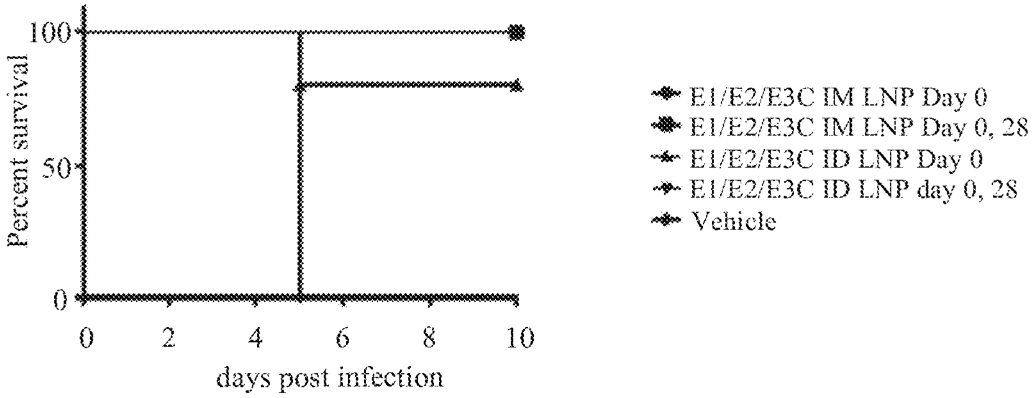
FIG. 6A is a graph showing the survival rates of AG129 mice vaccinated with a single 2 μg dose or two 2 μg doses of Chikungunya C-E3-E2-6K-E1 antigen administered either intramuscularly or intradermally.
Figure 6B:
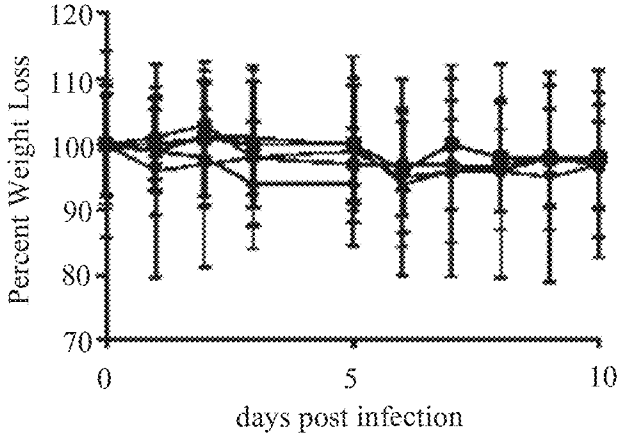
FIG. 6B is a graph showing the percent weight loss of AG129 mice vaccinated with a single 2 μg dose or two 2 μg doses of Chikungunya C-E3-E2-6K-E1 antigen administered either intramuscularly or intradermally.
Figure 6C:
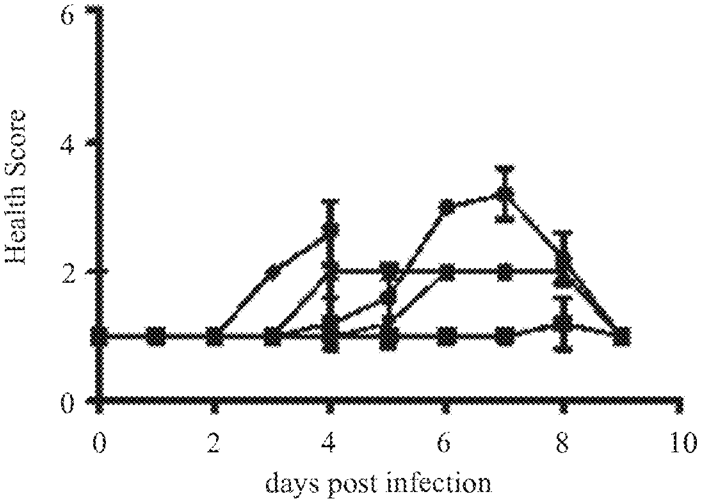
FIG. 6C is a graph showing the health scores of AG129 mice vaccinated with a single 2 μg dose or two 2 μg doses of Chikungunya C-E3-E2-6K-E1 antigen administered either intramuscularly or intradermally.
Figure 10A:
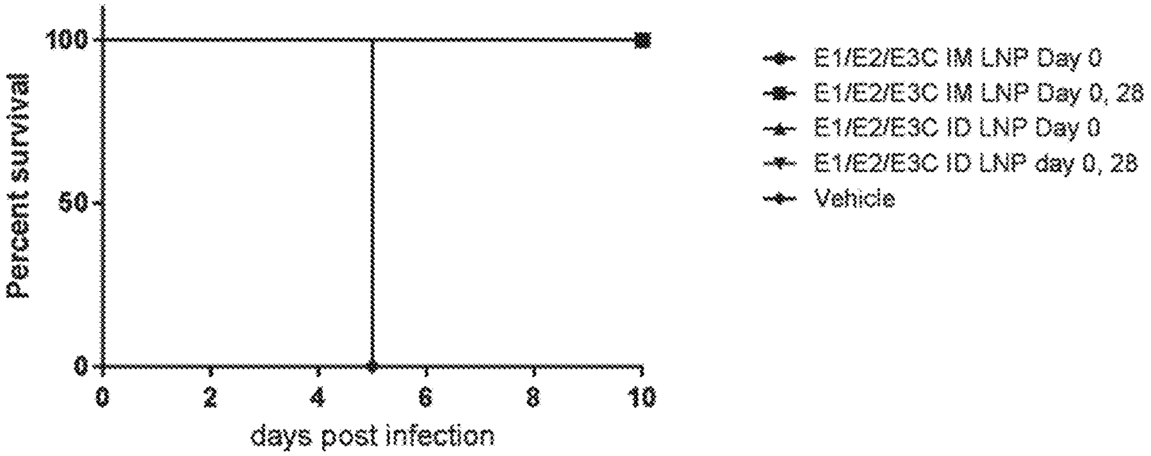
FIG. 10A is a graph showing the survival rates of AG129 mice vaccinated with a single 10 μg dose or two 10 μg doses of Chikungunya C-E3-E2-6K-E1 antigen administered either intramuscularly or intradermally.
Figure 10B:
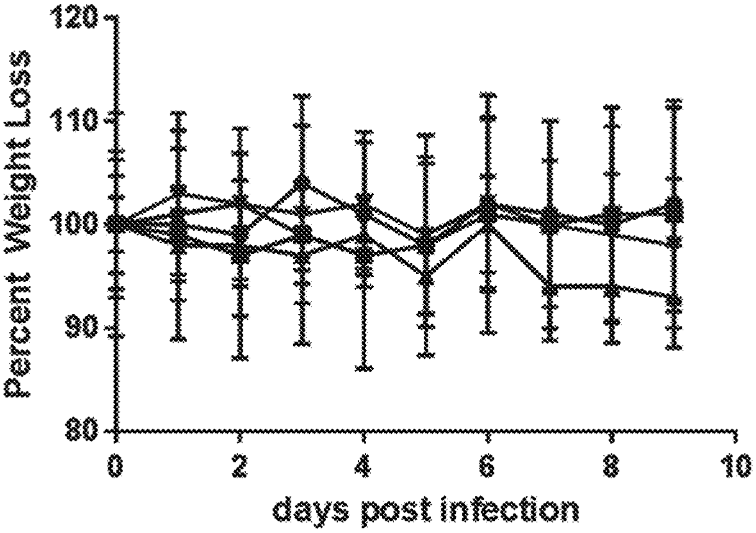
FIG. 10B is a graph showing the percent weight loss of AG129 mice vaccinated with a single 10 μg dose or two 10 μg doses of Chikungunya C-E3-E2-6K-E1 antigen administered either intramuscularly or intradermally.
Figure 10C:
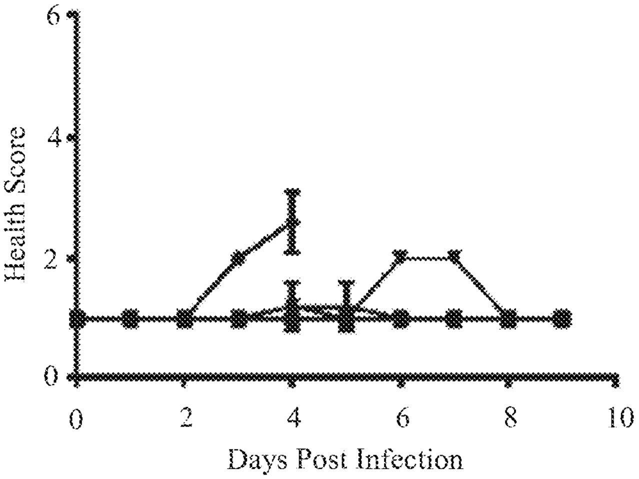
FIG. 10C is a graph showing the health scores of AG129 mice vaccinated with a single 10 μg dose or two 10 μg doses of Chikungunya C-E3-E2-6K-E1 antigen administered either intramuscularly or intradermally.

Example 12: Efficacy of Chikungunya C-E3-E2-6K-E1 Antigen mRNA Vaccine Candidate AG129 mice (n=5 per group) were vaccinated with 2 μg or 10 μg of MC-3-LNP formulated mRNA encoding CHIKV C-E3-E2-6K-E1 mRNA (SEQ ID NO:3). The AG129 mice were vaccinated on either Day 0 or Days 0 and 28 via IM or ID delivery. On Day 56 following final vaccination all mice were challenged with a lethal dose of CHIKV. The survival curve, percent weight loss, and health status of the mice vaccinated with 2 μg CHIKV C-E3-E2-6K-E1 mRNA are shown in FIGS. 6A-C. The survival results are tabulated in Table 10 below. The survival curve, percent weight loss, and health status of the mice vaccinated with 10 μg CHIKV C-E3-E2-6K-E1/E2/E3/C mRNA are shown in FIGS. 10A-C. The survival results are tabulated in Table 11 below.

TABLE 10

| Survival of mice vaccinated with Chikungunya C-E3-E2-6K-E1 antigen mRNA - 2 μg | | | | | |
|---|---|---|---|---|---|
| days post infection | E1/E2/E3C IM LNP Day 0 | E1/E2/E3C IM LNP Day 0, 28 | E1/E2/E3C ID LNP Day 0 | E1/E2/E3C ID LNP Day 0, 28 | Vehicle |
| 0.000 | 100.000 | 100.000 | 100.000 | 100.000 | 100.000 |
| 5.000 | | | 80.000 | | 0.000 |
| 10.000 | 100.000 | 100.000 | 80.000 | 100.000 | |

TABLE 11

| Survival of mice vaccinated with Chikungunya C-E3-E2-6K-E1 antigen mRNA - 10 μg | | | | | |
|---|---|---|---|---|---|
| days post infection | E1/E2/ E3C IM LNP Day 0 | E1/E2/ E3C IM LNP Day 0, 28 | E1/E2/ E3C ID LNP Day 0 | E1/E2/ E3C ID LNP Day 0, 28 | Vehicle |
| 0.000 | 100.000 | 100.000 | 100.000 | 100.000 | 100.000 |
| 5.000 | | | | | 0.000 |
| 10.000 | 100.000 | 100.000 | 100.000 | 100.000 | |

As shown in Table 10, the 2 μg dose of C-E3-E2-6K-E1 mRNA vaccine provided 100% protection post-CHIKV challenge when administered via IM in a single dose and provided 80% protection post-CHIKV challenge when administered via ID in a single dose. The 2 μg dose of C-E3-E2-6K-E1 mRNA vaccine provided 100% protection post-CHIKV challenge when administered via IM or ID in two doses. As shown in Table 11, the 10 μg dose of C-E3-E2-6K-E1 mRNA vaccine provided 100% protection post-CHIKV infection challenge when administered via IM or ID in either a single dose or in two doses.

In all experiments, the negative control mice had a ~0% survival rate, as did the positive control mice (heat-inactivated CHIKV) which died prior to CHIKV challenge. Some mice died during the vaccination period.

Example 13: Summary of Survival Data Using Chikungunya Antigen mRNA Vaccine Candidates CHIKV E1, CHIKV E2, and CHIKV C-E3-E2-6K-E1

Table 12 shows the survival data of the mice vaccinated with the CHIKV mRNA antigens used in the studies reported in Examples 10-12.

TABLE 12

| Summary of Day 6 post-injection survival data | | | |
|---|---|---|---|
| G# | Antigen/route/regime | Dose 10 ug/mouse (survival %) | Dose 2 ug/mouse (survival %) |
| 1 | Chik-E1-IM- single dose | 0 | 0 |
| 2 | Chik-E1-IM- two doses | 60 | 0 |
| 3 | Chik-E1-ID- single dose | 0 | 0 |
| 4 | Chik-E1-ID- two doses | 80 | 0 |
| 5 | Chik-E2-IM- single dose | 0 | 0 |
| 6 | Chik-E2-IM- two doses | 100 | 80 |
| 7 | Chik-E2-ID- single dose | 0 | 0 |
| 8 | Chik-E2-ID- two doses | 100 | 100 |
| 9 | Chik-E1-E2-E3-C-6KIM- single dose | 100 | 100 |
| 10 | Chik-E1-E2-E3-C-6KIM- two doses | 100 | 100 |
| 11 | Chik-E1-E2-E3-C-6KID- single dose | 100 | 80 |
| 12 | Chik-E1-E2-E3-C-6KID- two doses | 100 | 100 |
| 13 | HI CHIKV (+) | 0 | 0 |
| 14 | HI CHIKV (+) | 0 | 0 |
| 15 | Control (−) | 0 | 0 |

Figure 3:
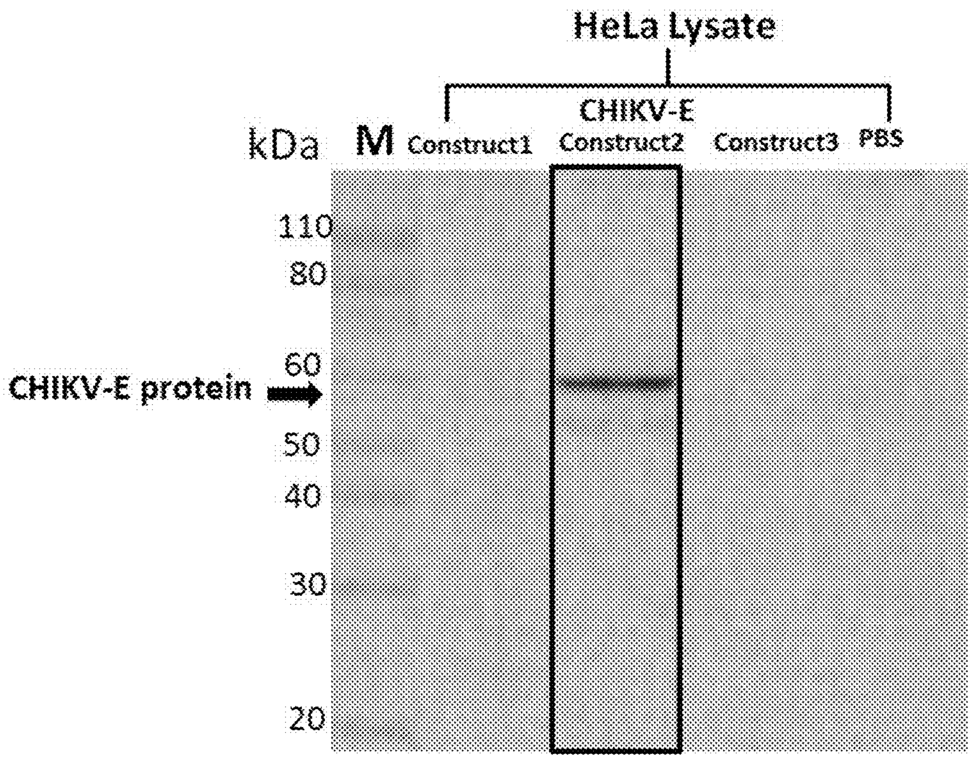
FIG. 3 shows CHIKV envelope protein detection of lysate in HeLa cells 16 hours post-transfection.

Example 14: In Vitro Transfection of mRNA-Encoded Chikungunya Virus Envelope Protein The in vitro transfection of mRNA encoding Notch and a PBS control were performed in 150k HeLa cells/well transfected with 1 μg mRNA+2 μL LF2000/well in a 24 well plate. Lysate containing proteins expressed from the CHIKV envelope mRNAs transfected in HeLa cells were collected 16 hours post-transfection and then detected by Western blotting with a V5 tag-HRP antibody. The successful detection of a CHIKV envelope protein is shown in FIG. 3.

Example 15: Detection of Immunity (Mouse IgG) Against Either Chikungunya-Specific E1, Chikungunya-Specific E2, or Chikungunya-Specific E1 and E2 Proteins Serum samples from mice vaccinated with the CHIKV E1, E2, or E1-E2-E3-C vaccine described in Examples 11-13 were tested using a semi-quantitative ELISA for the detection of mouse IgG against either Chikungunya-specific E1, Chikungunya-specific E2, or Chikungunya-specific E1 and E2 proteins.

Fifteen groups of five mice were vaccinated via intradermal (ID) or intramuscular (IM) injection with either 2 μg or 10 μg of the candidate vaccine. The vaccines were given to AG129 mice as single or two doses (second dose provided 28 days after the first dose). On day 56, mice were challenged with 1×104 PFU of CHIKV via ID injection in 50 μL volume and monitored for 10 days for weight loss, morbidity, and mortality. Mice were bled on day 7 and day 28 post-vaccination via the peri-orbital sinus (retro-orbital bleed). In addition, mice surviving the CHIKV challenge were bled 10 days post-challenge.

The individual samples were tested for reactivity in a semi-quantitative ELISA for mouse IgG against either Chikungunya-specific E1, Chikungunya-specific E2, or Chikungunya-specific E1 and E2 proteins. The results are shown in FIGS. 50-52.

Figure 51:
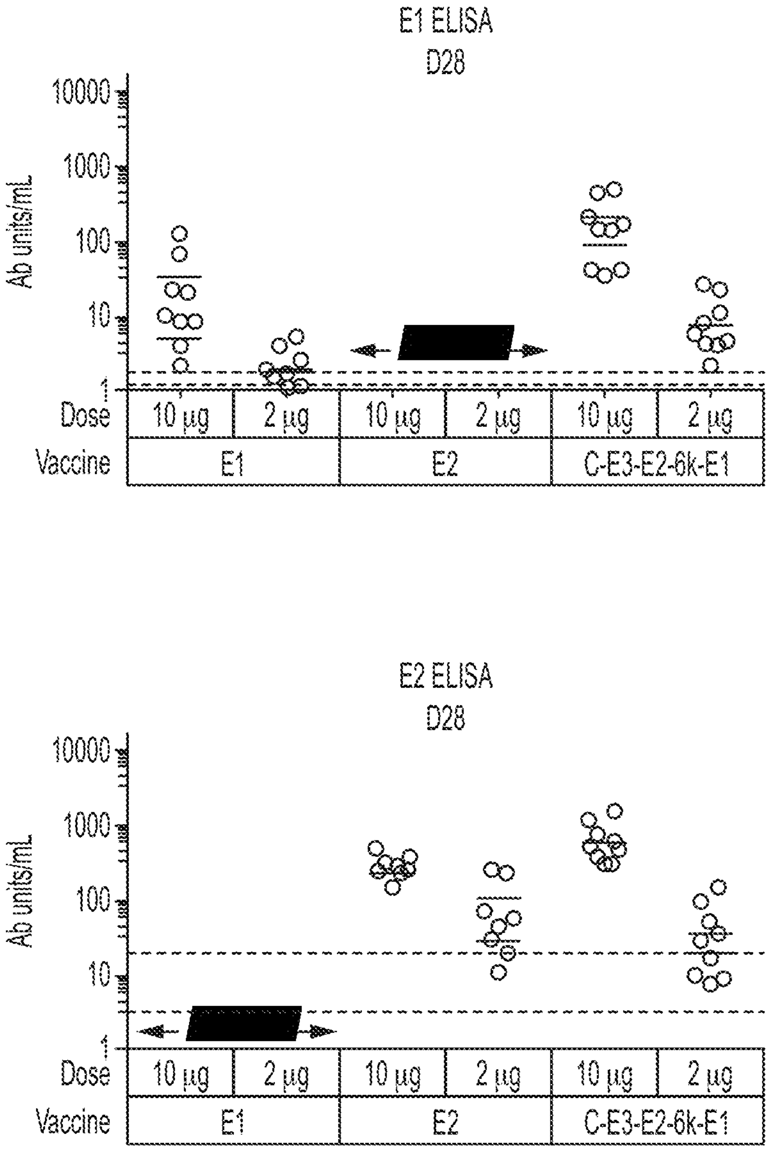
FIG. 51 shows a set of graphs depicting results of an ELISA assay to identify the amount of antibodies produced in AG129 mice in response to vaccination with mRNA encoding secreted CHIKV E1 structural protein, secreted CHIKV E2 structural protein, or CHIKV full structural polyprotein C-E3-E2-6k-E1 at a dose of 10 μg or 2 μg at 28 days post immunization. The two panels depict different studies.
Figure 52:
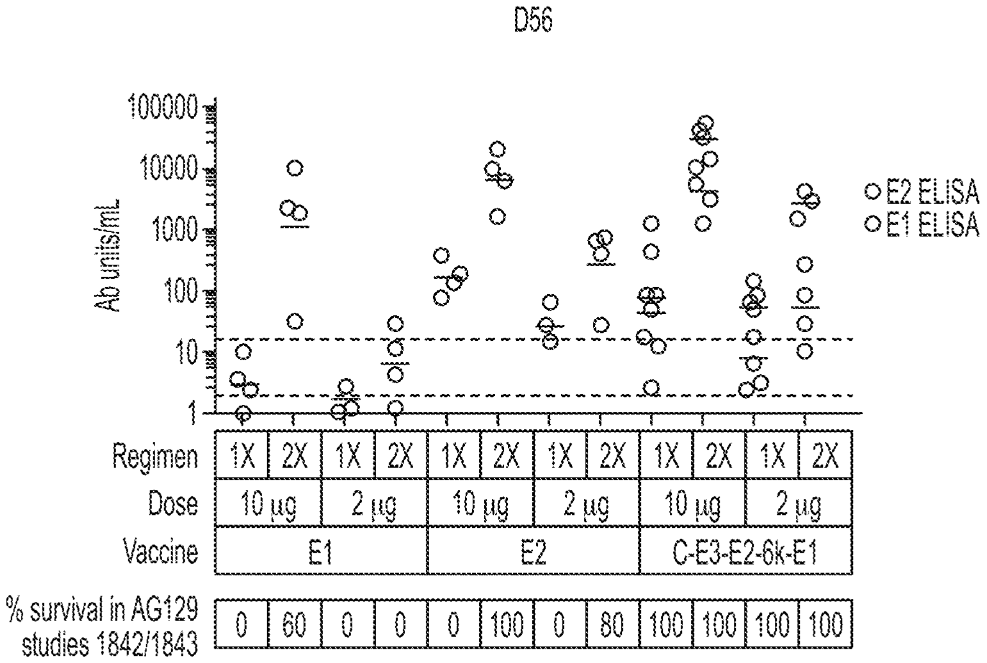
FIG. 52 is a graph depicting comparison of ELISA titers from the data of FIG. 50 to survival in the data of FIG. 51 left panel.

The data depicting the results of the ELISA assay to identify the amount of antibodies produced in AG129 mice in response to vaccination with mRNA encoding secreted CHIKV E1 structural protein, secreted CHIKV E2 structural protein, or CHIKV full structural polyprotein C-E3-E2-6k-E1 at a dose of 10 μg or 2 μg at 28 days post immunization is shown in FIGS. 50-51. The 10 μg of mRNA encoding CHIKV polyprotein produced significant levels of antibody in both studies. The data depicting a comparison of ELISA titers from the data of FIG. 50 to survival in the data of FIG. 51 left panel is shown in FIG. 52. As shown in the survival results, the animals vaccinated with either dose (single or double administration) of mRNA encoding CHIKV polyprotein had 100% survival rates.

Example 16: Efficacy of Chikungunya Polyprotein (C-E3-E2-6K-E1) mRNA Vaccine Candidate AG129 mice (n=5 per group) were vaccinated with either 10 μg, 2 μg or 0.4 μg of MC-3-LNP formulated mRNA encoded CHIKV polyprotein (C-E3-E2-6K-E1) (SEQ ID NO: 13). The mice were vaccinated on either Day 0 or Days 0 and 28 via IM delivery. In one study, all mice were challenged on day 56 with a lethal dose of CHIKV following final vaccination. In another study, all mice were challenged on day 84 with a lethal dose of CHIKV following final vaccination. The survival curve, percent weight loss, and health status of the mice vaccinated with 10 μg, 2 μg or 0.4 μg mRNA were determined as described previously in Examples 10-12. The survival rates, neutralizing antibodies and binding antibodies were assessed. Neutralizing antibodies were also identified against three different strains of CHIKV.

Figure 53:
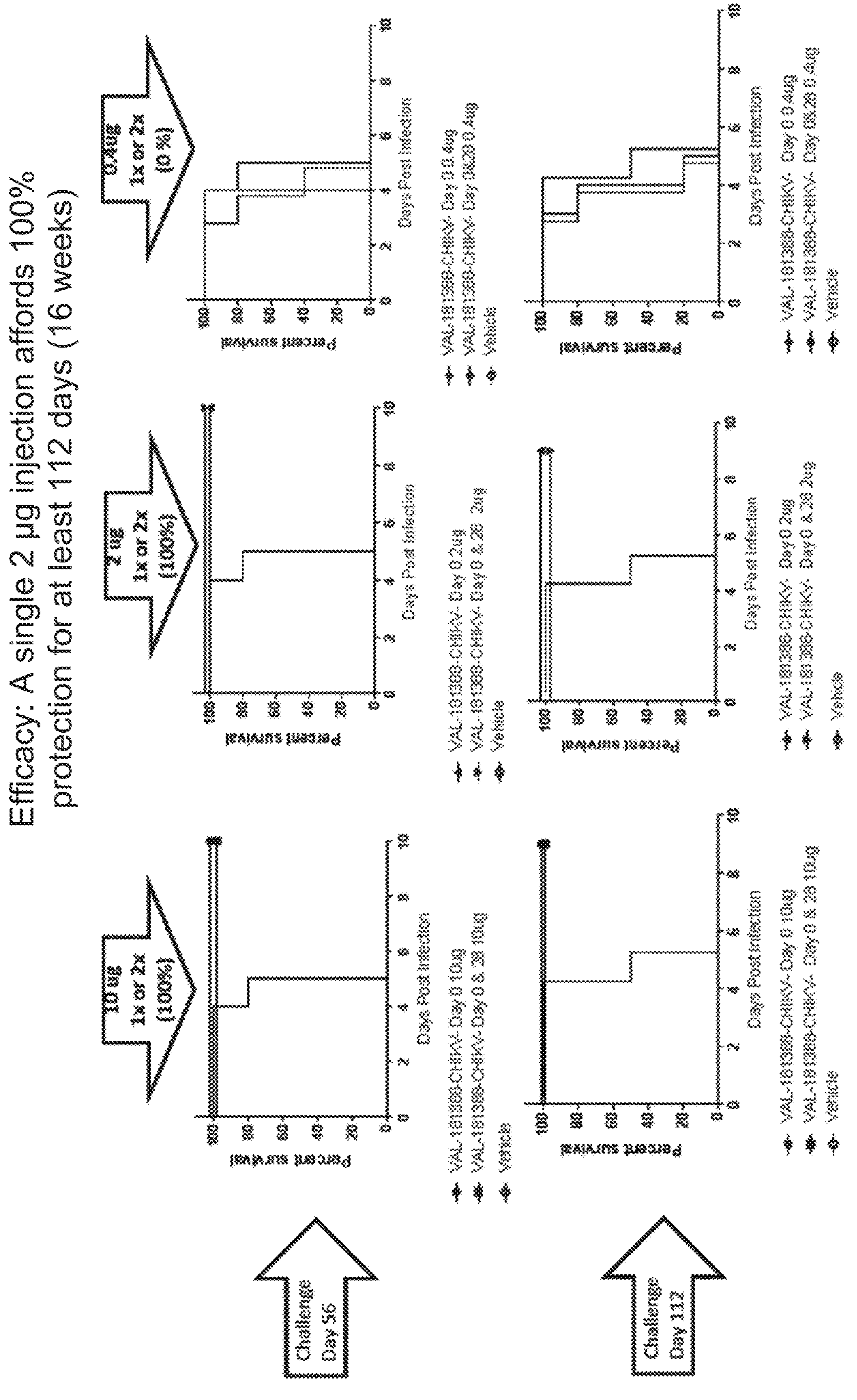
FIG. 53 shows a set of graphs depicting efficacy results in mice in response to vaccination with mRNA encoding CHIKV full structural polyprotein C-E3-E2-6k-E1 at a dose of 10 μg (left panels), 2 μg (middle panels) or 0.4 μg (right panels) at 56 days (top panels) or 112 days (bottom panels) post immunization.

The survival rates of the mice vaccinated with mRNA encoding CHIKV C-E3-E2-6k-E1 is shown in FIG. 53. The data depicts vaccination at a dose of 10 μg (left panels), 2 μg (middle panels) or 0.4 μg (right panels) at 56 days (top panels) or 112 days (bottom panels) post immunization. These data demonstrate that a single 2 μg dose of the mRNA vaccine afforded 100% protection for at least 112 days (16 weeks.) Following 5 the study out further, the data demonstrated that a single 2 μg dose of the mRNA vaccine afforded 100% protection for at least 140 days (20 weeks.)

Figure 54:
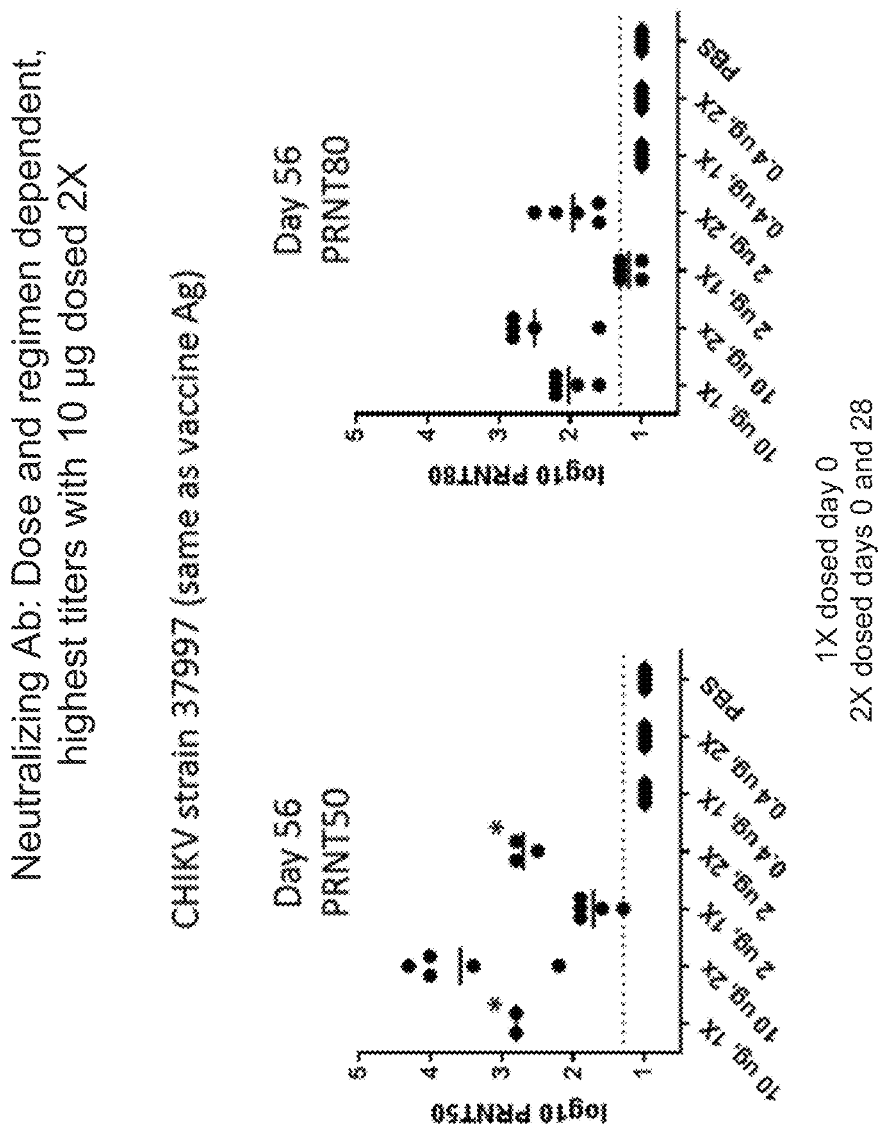
FIG. 54 shows a set of graphs depicting amount of neutralizing antibody produced in mice in response to vaccination with mRNA encoding CHIKV full structural polyprotein C-E3-E2-6k-E1 at a dose of 10 μg, 2 μg, or 0.4 μg at 56 days post immunization.
Figure 55:
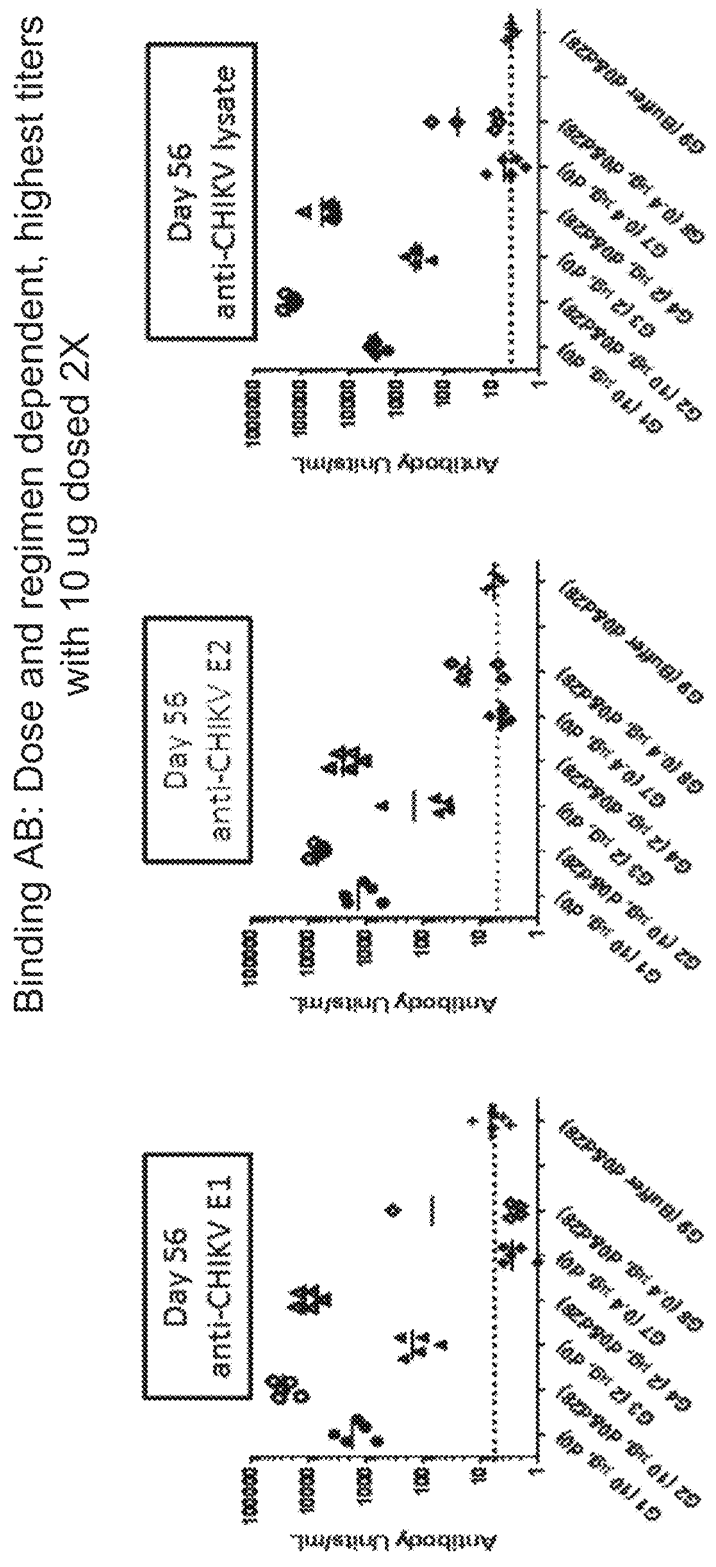
FIG. 55 shows a set of graphs depicting binding antibody produced in mice in response to vaccination with mRNA encoding CHIKV full structural polyprotein C-E3-E2-6k-E1 at a dose of 10 μg, 2 μg, or 0.4 μg at 56 days post immunization (top panels) and the corresponding correlation between binding and neutralizing antibodies (bottom panels).
Figure 55:
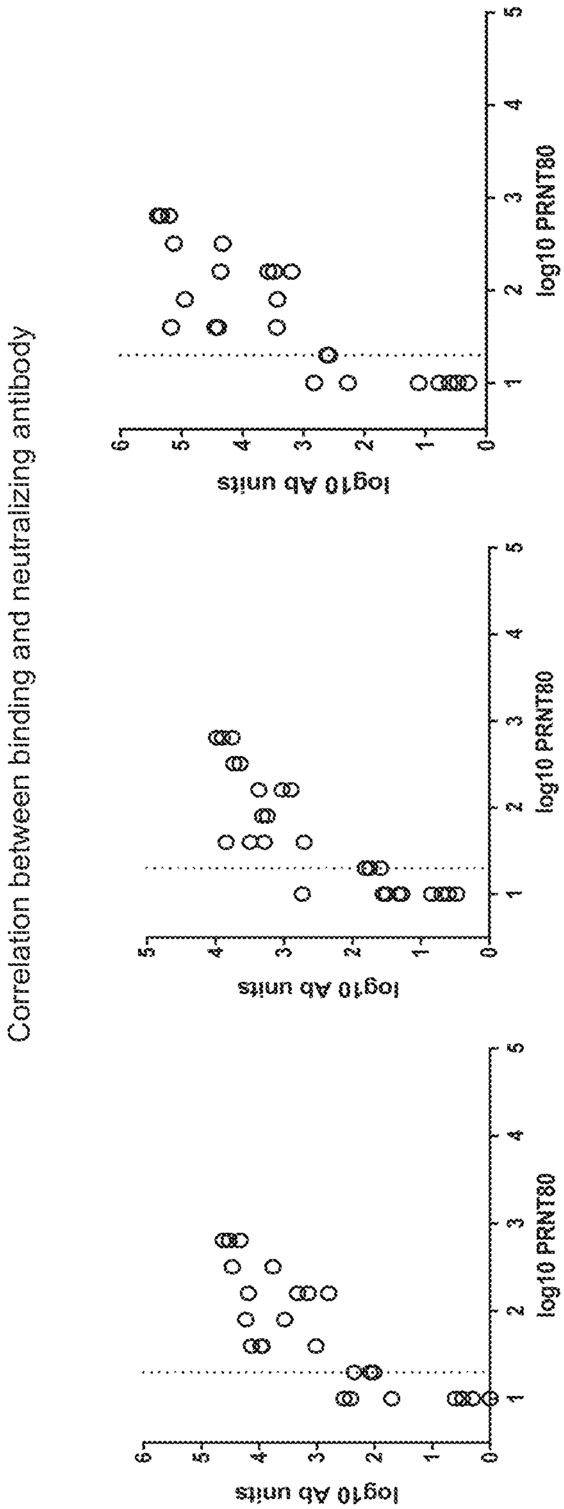

The neutralizing antibody and binding antibody produced in treated mice is shown in FIGS. 54 and 55 respectively. As can be seen in FIGS. 54 and 55, the levels of neutralizing Ab were dependent or dose and regimen with the highest titers evident with 10 μg dosed twice (days 0 and 28). Plaque reduction neutralization tests (PRNT50 and PRNT80) were used to quantify the titer of neutralizing antibody for the virus. Antigen binding Ab was determined by ELISA. The corresponding correlation between binding Ab and neutralizing antibodies is shown in the bottom panels of FIG. 55. Following the study out to 16 weeks showed that the highest E1 titers were achieved when 10 μg mRNA vaccine was dosed twice.

Figure 56:
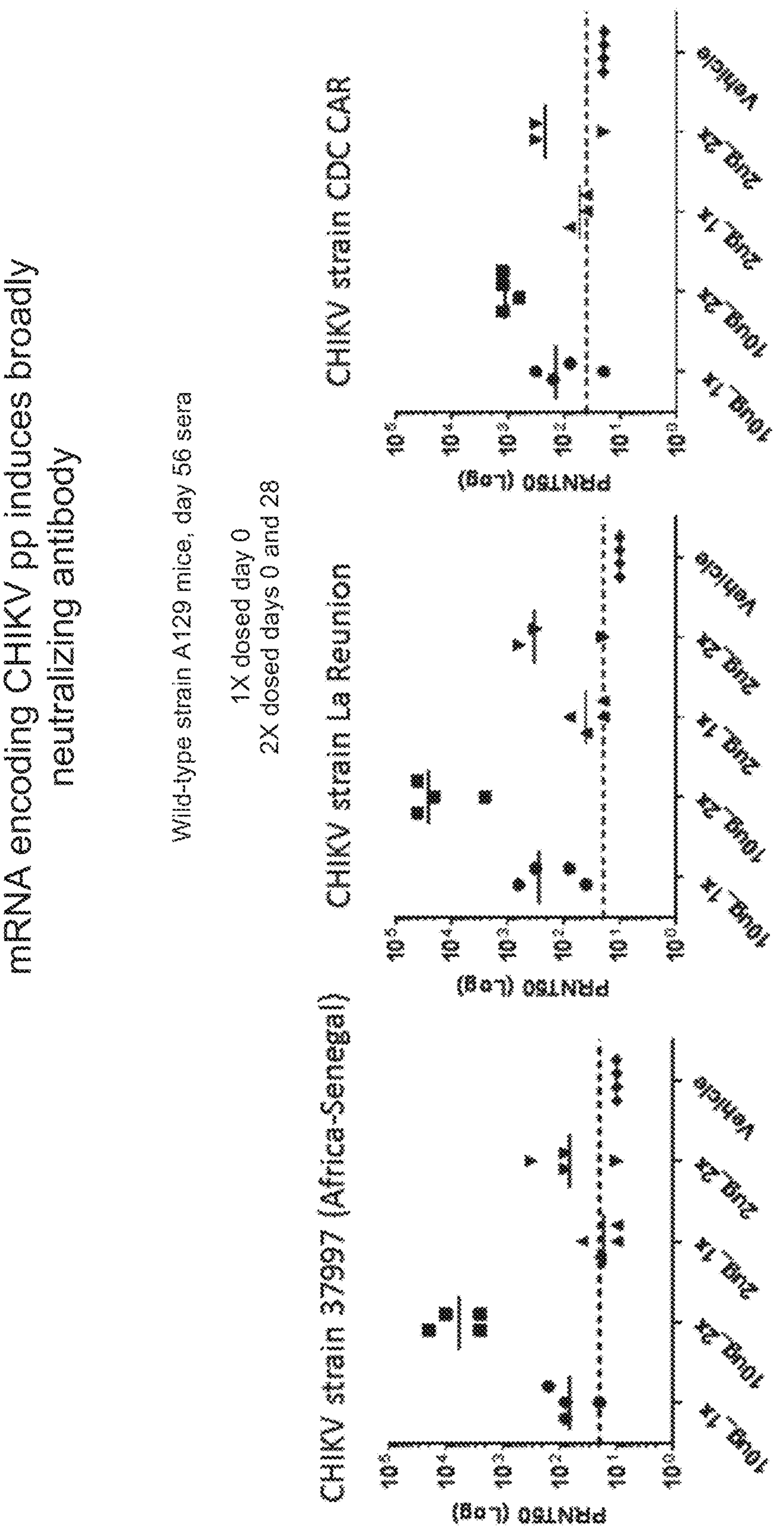
FIG. 56 shows a set of graphs depicting amount of neutralizing antibody produced in A129 mice in response to vaccination with mRNA encoding CHIKV full structural polyprotein C-E3-E2-6k-E1 at a dose of 10 μg, 2 μg, or 0.4 μg at 56 days post immunization against three different strains of CHIKV, African-Senegal (left panel), La Reunion (middle panel) and CDC CAR (right panel).
Figure 57:
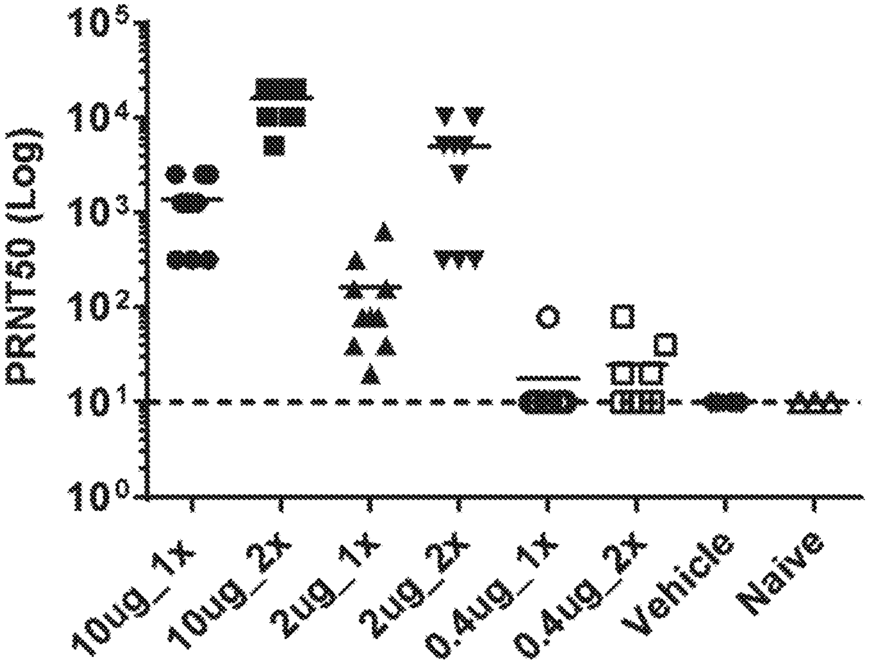
FIG. 57 shows a graph depicting neutralizing antibodies against CHIKV S27 strain.

The data depicting neutralizing antibodies against three different strains of CHIKV is shown in FIG. 56. The neutralizing antibodies were tested against three different strains of CHIKV, African-Senegal (left panel), La Reunion (middle panel) and CDC CAR (right panel). FIG. 56 shows that the polyprotein-encoding mRNA vaccine elicited broadly neutralizing antibodies against the three strains tested. Sera were further tested against Chik S27 strain (Chikungunya virus (strain S27-African prototype). The data depicting neutralizing antibodies against CHIKV S27 strain is shown in FIG. 57. These data collectively show that the polyprotein encoding mRNA vaccine elicited broadly neutralizing antibodies against all four strains tested. The vaccine induced neutralizing antibodies against multiple strains of Chikungunya. The prime and boost with the 10 μg dose produced the most robust neutralizing antibody response followed by the single dose with 10 μg.

Example 17: Transfection of mRNA Encoded CHIKV Structural Proteins

In vitro transfection of mRNA encoding CHIKV structural proteins and PBS control were performed in 400 k HeLa cells transfected with 1.25 ug mRNA lipoplexed with 5 ul LF2000/well in 6 well plate. Protein detection in HeLa cell lysate 16 h post transfection was measured. Lysates which contain proteins expressed from the CHIKV mRNAs transfected in HeLa were collected 16 h post transfection. Proteins were detected by WB with anti Flag or and V5 antibody.

Figure 12:
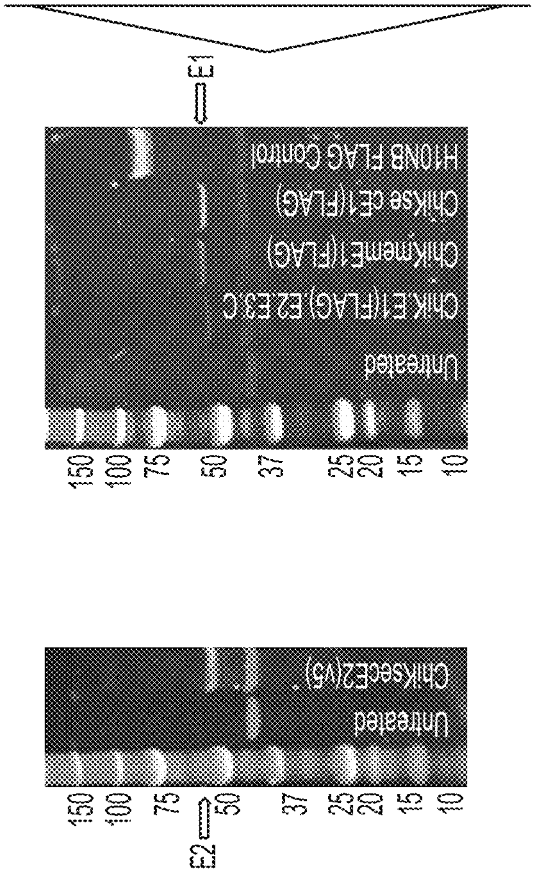
FIG. 12 shows the results of an in vitro transfection of mRNA encoded CHIKV structural proteins. Protein detection in HeLa cell lysate 16 h post transfection is detected.
Figure 13A:
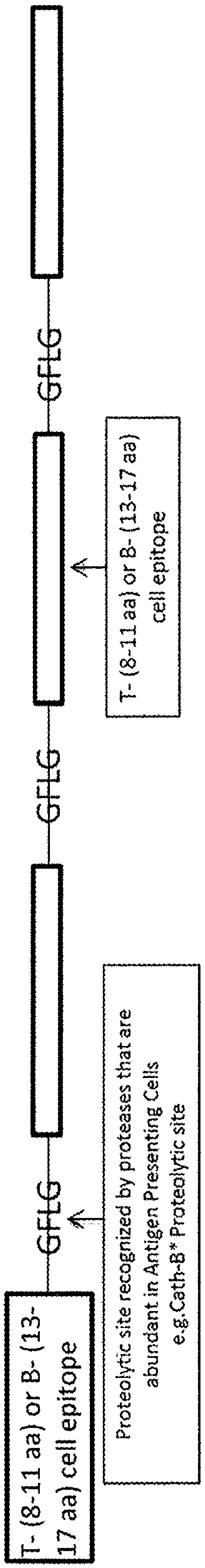
FIGS. 13A and 13B are schematics of an exemplary DENY peptide epitope. The polypeptide of FIG. 13A includes two or more epitopes. The epitopes can be of the same sequence or different sequence and can be all T-cell epitopes, all B-cell epitopes or a combination of both. The schematic of FIG. 13B shows the peptide epitope with various end units for enhancing MHC processing of the peptides.
Figure 13B:
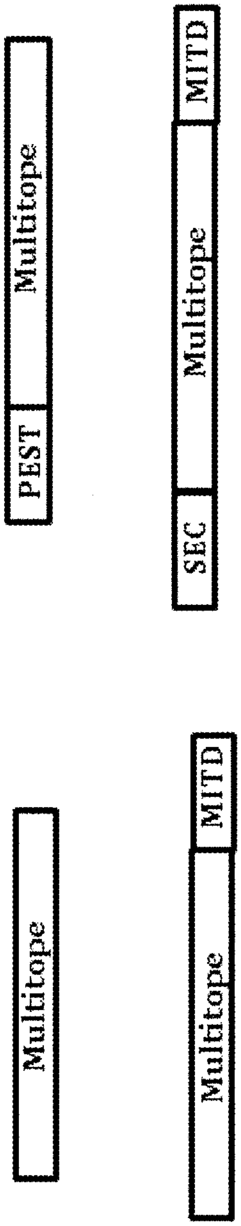
Figure 14:
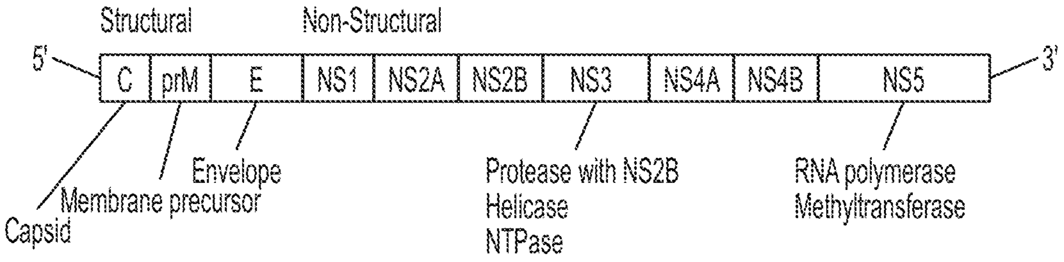
FIG. 14 is a schematic of a dengue viral genome including structural and nonstructural components.

FIG. 12 show the results of the assay. mRNA encoded CHIKV structural proteins. Protein production in the HeLa cell lysate 16 h post transfection was detected.

Example 18: Exemplary Dengue Sequences

The following are nucleic acid (SEQ ID NO: 16, 18, 20, and 22) and amino acid (SEQ ID NO: 15, 17, 19, and 21) sequences for each of DEN-1, DEN-2, DEN-3, and DEN-4.

TABLE 13

DENV polynucleotide sequences and amino acid sequences

| Name | Sequence | SEQ ID NO |
|---|---|---|
| DEN-1 (NC_001477.1) | MNNQRKKTGRPSFNMLKRARNRVSTVSQLAKRFSKGLLSGQGPMKLVMAF<br>IAFLRFLAIPPTAGILARWGSFKKNGAIKVLRGFKKEISNMLNIMNRRKR<br>SVTMLLMLLPTALAFHLTTRGGEPHMIVSKQERGKSLLFKTSAGVNMCTL<br>IAMDLGELCEDTMTYKCPRITETEPDDVDCWCNATETWVTYGTCSQTGEH<br>RRDKRSVALAPHVGLGLE<br>TRTETWMSSEGAWKQIQKVETWALRHPGFTVIALFLAHAIGTSITQKGII<br>FILLMLVTPSMAMRCVGIGNRDFVEGLSGATWVDVVLEHGSCVTTMAKDK<br>PTLDIELLKTEVTNPAVLRKLCIEAKISNTTTDSRCPTQGEATLVEEQDT<br>NFVCRRTFVDRGWGNGCGLFGKGSLITCAKFKCVTKLEGKIVQYENLKYS<br>VIVTVHTGDQHQVGNETTEHGTTATITPQAPTSEIQLTDYGALTLDCSPR<br>TGLDFNEMVLLTMKKKSWLVHKQWFLDLPLPWTSGASTSQETWNRQDLLV<br>TFKTAHAKKQEVVVLGSQEGAMHTALTGATEIQTSGTTTIFAGHLKCRLK<br>MDKLILKGMSYVMCTGSFKLEKEVAETQHGTVLVQVKYEGTDAPCKIPFS<br>SQDEKGVTQNGRLITANPIVTDKEKPVNIEAEPPFGESYIVVGAGEKALK<br>LSWFKKGSSIGKMFEATARGARRMAILGDTAWDFGSIGGVFTSVGKLIHQ<br>IFGTAYGVLFSGVSWTMKIGIGILLTWLGLNSRSTSLSMTCIAVGMVTLY<br>LGVMVQADSGCVINWKGRELKCGSGIFVTNEVHTWTEQYKFQADSPKRLS<br>AAIGKAWEEGVCGIRSATRLENIMWKQISNELNHILLENDMKFTVVVGDV<br>SGILAQGKKMIRPQPMEHKYSWKSWGKAKIIGADVQNTTFIIDGPNTPEC<br>PDNQRAWNIWEVEDYGFGIFTTNIWLKLRDSYTQVCDHRLMSAAIKDSKA<br>VHADMGYWIESEKNETWKLARASFIEVKTCIWPKSHTLWSNGVLESEMII<br>PKIYGGPISQHNYRPGYFTQTAGPWHLGKLELDFDLCEGTTVVVDEHCGN<br>RGPSLRTTTVTGKTIHEWCCRSCTLPPLRFKGEDGCWYGMEIRPVKEKEE<br>NLVKSMVSAGSGEVDSFSLGLLCISIMIEEVMRSRWSRKMLMTGTLAVFL<br>LLTMGQLTWNDLIRLCIMVGANASDKMGMGTTYLALMATFRMRPMFAVGL<br>LFRRLTSREVLLLTVGLSLVASVELPNSLEELGDGLAMGIMMLKLLTDFQ<br>SHQLWATLLSLTFVKTTFSLHYAWKTMAMILSIVSLFPLCLSTTSQKTTW<br>LPVLLGSLGCKPLTMFLITENKIWGRKSWPLNEGIMAVGIVSILLSSLLK<br>NDVPLAGPLIAGGMLIACYVISGSSADLSLEKAAEVSWEEEAEHSGASHN<br>ILVEVQDDGTMKIKDEERDDTLTILLKATLLAISGVYPMSIPATLFVWYF<br>WQKKKQRSGVLWDTPSPPEVERAVLDDGIYRILQRGLLGRSQVGVGVFQE<br>GVFHTMWHVTRGAVLMYQGKRLEPSWASVKKDLISYGGGWRFQGSWNAGE<br>EVQVIAVEPGKNPKNVQTAPGTFKTPEGEVGAIALDFKPGTSGSPIVNRE<br>GKIVGLYGNGVVTTSGTYVSAIAQAKASQEGPLPEIEDEVFRKRNLTIMD<br>LHPGSGKTRRYLPAIVREAIKRKLRTLVLAPTRVVASEMAEALKGMPIRY<br>QTTAVKSEHTGKEIVDLMCHATFTMRLLSPVRVPNYNMIIMDEAHFTDPA<br>SIAARGYISTRVGMGEAAAIFMTATPPGSVEAFPQSIQDEERDIPERSWN | 15 |

TABLE 13-continued

DENV polynucleotide sequences and amino acid sequences

| Name | Sequence | SEQ ID NO |
|---|---|---|
| | SGYDWITDFPGKTVWFVPSIKSGNDIANCLRKNGKRVVQLSRKTFDTEYQ<br>KTKNNDWDYVVTTDISEMGANFRADRVIDPRRCLKPVILKDGPERVILAG<br>PMPVTVASAAQRRGRIGRNQNKEGDQYIYMGQPLNNDEDHAHWTEAKMLL<br>DNINTPEGIIPALFEPEREKSAAIDGEYRLRGEARKTFVELMRRGDLPVW<br>LSYKVASEGFQYSDRRWCFDGERNNQVLEENMDVEIWTKEGERKKLRPRW<br>LDARTYSDPLALREFKEFAAGRRSVSGDLILEIGKLPQHLTQRAQNALDN<br>LVMLHNSEQGGKAYRHAMEELPDTIETLMLLALIAVLTGGVTLFFLSGRG<br>LGKTSIGLLCVIASSALLWMASVEPHWIAASIILEFFLMVLLIPEPDRQR<br>TPQDNQLAYVVIGLLFMILTVAANEMGLLETTKKDLGIGHAAAENHHHAA<br>MLDVDLHPASAWTLYAVATTIITPMMRHTIENTTANISLTAIANQAAILM<br>GLDKGWPISKMDIGVPLLALGCYSQVNPLTLTAAVLMLVAHYAIIGPGLQ<br>AKATREAQKRTAAGIMKNPTVDGIVAIDLDPVVYDAKFEKQLGQIMLLIL<br>CTSQILLMRTTWALCESITLATGPLTTLWEGSPGKFWNTTIAVSMANIFR<br>GSYLAGAGLAFSLMKSLGGGRRGTGAQGETLGEKWKRQLNQLSKSEFNTY<br>KRSGIIEVDRSEAKEGLKRGETTKHAVSRGTAKLRWFVERNLVKPEGKVI<br>DLGCGRGGWSYYCAGLKKVTEVKGYTKGGPGHEEPIPMATYGWNLVKLYS<br>GKDVFFTPPEKCDTLLCDIGESSPNPTIEEGRTLRVLKMVEPWLRGNQFC<br>IKILNPYMPSVVETLEQMQRKHGGMLVRNPLSRNSTHEMYWVSCGTGNIV<br>SAVNMTSRMLLNRFTMAHRKPTYERDVDLGAGTRHVAVEPEVANLDIIGQ<br>RIENIKNEHKSTWHYDEDNPYKTWAYHGSYEVKPSGSASSMVNGVVRLLT<br>KPWDVIPMVTQIAMTDTTPFGQQRVFKEKVDTRTPKAKRGTAQIMEVTAR<br>WLWGFLSRNKKPRICTREEFTRKVRSNAAIGAVFVDENQWNSAKEAVEDE<br>RFWDLVHRERELHKQGKCATCVYNMMGKREKKLGEFGKAKGSRAIWYMWL<br>GARFLEFEALGFMNEDHWFSRENSLSGVEGEGLHKLGYILRDISKIPGGN<br>MYADDTAGWDTRITEDDLQNEAKITDIMEPEHALLATSIFKLTYQNKVVR<br>VQRPAKNGTVMDVISRRDQRGSGQVGTYGLNTFTNMEAQLIRQMESEGIF<br>SPSELETPNLAERVLDWLKKHGTERLKRMAISGDDCVVKPIDDRFATALT<br>ALNDMGKVRKDIPQWEPSKGWNDWQQVPFCSHHFHQLIMKDGREIVVPCR<br>NQDELVGRARVSQGAGWSLRETACLGKSYAQMWQLMYFHRRDLRLAANAI<br>CSAVPVDWVPTSRTTWSIHAH<br>HQWMTTEDMLSVWNRVWIEENPWMEDKTHVSSWEDVPYLGKREDQWCGSL<br>IGLTARATWATNIQVAINQVRRLIGNENYLDFMTSMKRFKNESDPEGALW | |
| DEN-1<br>(NC_001477.1) | agttgttagtctacgtggaccgacaagaacagtttcgaatcggaagcttg<br>cttaacgtagttctaacagtttttattagagagcagatctctgatgaac<br>aaccaacggaaaaagacgggtcgaccgtctttcaatatgctgaaacgcgc<br>gagaaaccgcgtgtcaactgtttcacagttggcgaagagattctcaaaag<br>gattgctttcaggccaaggacccatgaaattggtgatggcttttatagca<br>ttcctaagatttctagccatacctccaacagcaggaattttggctagatg<br>gggctcattcaagaagaatggagcgatcaaagtgttacggggtttcaaga<br>aagaaatctcaaacatgttgaacataatgaacaggaggaaaagatctgtg<br>accatgctcctcatgctgctgcccacagccctggcgttccatctgaccac<br>ccgagggggagagccgcacatgatagttagcaagcaggaaagaggaaaat<br>cacttttgtttaagacctctgcaggtgtcaacatgtgcacccttattgca<br>atggatttgggagagttatgtgaggacacaatgacctacaaatgcccccg<br>gatcactgagacggaaccagatgacgttgactgttggtgcaatgccacgg<br>agacatgggtgacctatggaacatgttctcaaactggtgaacaccgacga<br>gacaaacgttccgtcgcactggcaccacacgtagggcttggtctagaaac<br>aagaaccgaaacgtggatgtcctctgaaggcgcttggaaacaaatacaaa<br>aagtggagacctgggctctgagacacccaggattcacggtgatagccctt<br>tttctagcacatgccataggaacatccatcacccagaaagggatcatttt<br>tattttgctgatgctggtaactccatccatggccatgcggtgcgtgggaa<br>taggcaacagagacttcgtggaaggactgtcaggagctacgtgggtggat<br>gtggtactggagcatggaagttgcgtcactaccatggcaaaagacaaacc<br>aacactggacattgaactcttgaagacggaggtcacaaaccctgccgtcc<br>tgcgcaaactgtgcattgaagctaaaatatcaaacaccaccaccgattcg<br>agatgtccaacacaaggagaagccacgctggtggaagaacaggacacgaa<br>ctttgtgtgtcgacgaacgttcgtggacagaggctggggcaatggttgtg<br>ggctattcggaaaaggtagcttaataacgtgtgctaagtttaagtgtgtg<br>acaaaactggaaggaaagatagtccaatatgaaaacttaaaatattcagt<br>gatagtcaccgtacacactggagaccagcaccaagttggaaatgagacca<br>cagaacatggaacaactgcaaccataacacctcaagctcccacgtcggaa<br>atacagctgacagactacggagctctaacattggattgttcacctagaac<br>agggctagactttaatgagatggtgttgttgacaatgaaaaaaaaatcat<br>ggctcgtccacaaacaatggtttctagacttaccactgccttggacctcg<br>gggcttcaacatcccaagagacttggaatagacaagacttgctggtcac<br>atttaagacagctcatgcaaaaaagcaggaagtagtcgtactaggatcac<br>aagaaggagcaatgcacactgcgttgactggagcgacagaaatccaaacg<br>tctggaacgacaacaatttttgcaggacacctgaaatgcagattaaaaat<br>ggataaactgattttaaaagggatgtcatatgtaatgtgcacagggtcat<br>tcaagttagagaaggaagtggctgagacccagcatggaactgttctagtg<br>caggttaaatacgaaggaacagatgcaccatgcaagatccccttctcgtc<br>ccaagatgagaagggagtaacccagaatgggagattgataacagccaacc<br>ccatagtcactgacaaagaaaaaccagtcaacattgaagcggagccacct<br>tttggtgagagctacattgtggtaggagcaggtgaaaaagctttgaaact | 16 |

TABLE 13-continued

DENV polynucleotide sequences and amino acid sequences

| Name | Sequence | SEQ ID NO |
| --- | --- | --- |
| | aagctggttcaagaagggaagcagtatagggaaaatgtttgaagcaactg<br>cccgtggagcacgaaggatggccatcctgggagacactgcatgggacttc<br>ggttctataggaggggtgttcacgtctgtgggaaaactgatacaccagat<br>ttttgggactgcgtatggagttttgttcagcggtgtttcttggaccatga<br>agataggaatagggattctgctgacatggctaggattaaactcaaggagc<br>acgtccctttcaatgacgtgtatcgcagttggcatggtcacactgtacct<br>aggagtcatggttcaggcggactcgggatgtgtaatcaactggaaaggca<br>gagaactcaaatgtggaagcggcatttttgtcaccaatgaagtccacacc<br>tggacagagcaatataaattccaggccgactcccctaagagactatcagc<br>ggccattgggaaggcatgggaggagggtgtgtgtggaattcgatcagcca<br>ctcgtctcgagaacatcatgtggaagcaaatatcaaatgaattaaaccac<br>atcttacttgaaaatgacatgaaatttacagtggtcgtaggagacgttag<br>tggaatcttggcccaaggaaagaaaatgattaggccacaacccatggaac<br>acaaatactcgtggaaaagctggggaaaagccaaaatcataggagcagat<br>gtacagaataccaccttcatcatcgacggcccaaacaccccagaatgccc<br>tgataaccaaagagcatggaacatttgggaagttgaagactatggatttg<br>gaattttcacgacaaacatatggttgaaattgcgtgactcctacactcaa<br>gtgtgtgaccaccggctaatgtcagctgccatcaaggatagcaaagcagt<br>ccatgctgacatggggtactggatagaaagtgaaaagaacgagacttgga<br>agttggcaagagcctccttcatagaagttaagacatgcatctggccaaaa<br>tcccacactctatggagcaatggagtcctggaaagtgagatgataatccc<br>aaagatatatggaggaccaatatctcagcacaactacagaccaggatatt<br>tcacacaaacagcagggccgtggcacttgggcaagttagaactagatttt<br>gatttatgtgaaggtaccactgttgttgtggatgaacattgtggaaatcg<br>aggaccatctcttagaaccacaacagtcacaggaaagacaatccatgaat<br>ggtgctgtagatcttgcacgttacccccctacgtttcaaaggagaagac<br>gggtgctggtacggcatggaaatcagaccagtcaaggagaaggaagagaa<br>cctagttaagtcaatggtctctgcagggtcaggagaagtggacagttttt<br>cactaggactgctatgcatatcaataatgatcgaagaggtaatgagatcc<br>agatggagcagaaaaatgctgatgactggaacattggctgtgttcctcct<br>tctcacaatgggacaattgacatggaatgatctgatcaggctatgtatca<br>tggttggagccaacgcttcagacaagatggggatgggaacaacgtaccta<br>gctttgatggccactttcagaatgagaccaatgttcgcagtcgggctact<br>gtttcgcagattaacatctagagaagttcttcttcttacagttggattga<br>gtctggtggcatctgtagaactaccaaattccttagaggagctaggggat<br>ggacttgcaatgggcatcatgatgttgaaattactgactgattttcagtc<br>acatcagctatgggctaccttgctgtctttaacatttgtcaaaacaactt<br>tttcattgcactatgcatggaagacaatggctatgatactgtcaattgta<br>tctctcttccctttatgcctgtccacgacttctcaaaaaacaacatggct<br>tccggtgttgctgggatctcttggatgcaaaccactaaccatgtttctta<br>taacagaaaacaaaatctggggaaggaaaagctggcctctcaatgaagga<br>attatggctgttggaatagttagcattcttctaagttcacttctcaagaa<br>tgatgtgccactagctggcccactaatagctggaggcatgctaatagcat<br>gttatgtcatatctggaagctcggccgatttatcactggagaaagcggct<br>gaggtctcctgggaagaagaagcagaacactctggtgcctcacacaacat<br>actagtggaggtccaagatgatggaaccatgaagataaaggatgaagaga<br>gagatgacacactcaccattctcctcaaagcaactctgctagcaatctca<br>ggggtatacccaatgtcaataccggcgaccctctttgtgtggtattttg<br>gcagaaaaagaaacagagatcaggagtgctatgggacacacccagccctc<br>cagaagtggaaagagcagtccttgatgatggcatttatagaattctccaa<br>agaggattgttgggcaggtctcaagtaggagtaggagtttttcaagaagg<br>cgtgttccacacaatgtggcacgtcaccaggggagctgtcctcatgtacc<br>aagggaagagactggaaccaagttgggccagtgtcaaaaaagacttgatc<br>tcatatggaggaggttggaggtttcaaggatcctggaacgcgggagaaga<br>agtgcaggtgattgctgttgaaccggggaagaaccccaaaaatgtacaga<br>cagcgccgggtaccttcaagacccctgaaggcgaagttggagccatagct<br>ctagactttaaacccggcacatctggatctcctatcgtgaacagagaggg<br>aaaaatagtaggtctttatggaaatggagtggtgacaacaagtggtacct<br>acgtcagtgccatagctcaagctaaagcatcacaagaagggcctctacca<br>gagattgaggacgaggtgtttaggaaaagaaacttaacaataatggacct<br>acatccaggatcgggaaaaacaagaagataccttccagccatagtccgtg<br>aggccataaaaagaaagctgcgcacgctagtcttagctcccacaagagtt<br>gtcgcttctgaaatggcagaggcgctcaagggaatgccaataaggtatca<br>gacaacagcagtgaagagtgaacacacgggaaaggagatagttgacctta<br>tgtgtcacgccactttcactatgcgtctcctgtctcctgtgagagttccc<br>aattataatatgattatcatggatgaagcacattttaccgatccagccag<br>catagcagccagagggtatatctcaacccgagtgggtatgggtgaagcag<br>ctgcgattttcatgacagccactcccccggatcggtggaggcctttcca<br>cagagcaatgcagttatccaagatgaggaaagagacattcctgaaagatc<br>atggaactcaggctatgactggatcactgatttcccaggtaaaacagtct<br>ggtttgttccaagcatcaaatcaggaaatgacattgccaactgtttaaga<br>aagaatgggaaacgggtggtccaattgagcagaaaaacttttgacactga<br>gtaccagaaaacaaaaaataacgactgggactatgttgtcacaacagaca<br>tatccgaaatgggagcaaacttccgagccgacagggtaatagacccgagg<br>cggtgcctgaaaccggtaatactaaaagatggcccagagcgtgtcattct | |

TABLE 13-continued

DENV polynucleotide sequences and amino acid sequences

| Name | Sequence | SEQ ID NO |
|---|---|---|
| | agccggaccgatgccagtgactgtggctagcgccgcccagaggagaggaa<br>gaattggaaggaaccaaaataaggaaggcgatcagtatatttacatggga<br>cagcctctaaacaatgatgaggaccacgcccattggacagaagcaaaaat<br>gctccttgacaacataaacacaccagaagggattatcccagccctctttg<br>agccggagagagaaaagagtgcagcaatagacggggaatacagactacgg<br>ggtgaagcgaggaaaacgttcgtggagctcatgagaagaggagatctacc<br>tgtctggctatcctacaaagttgcctcagaaggcttccagtactccgaca<br>gaaggtggtgctttgatggggaaaggaacaaccaggtgttggaggagaac<br>atggacgtggagatctggacaaaagaaggagaaagaaagaaactacgacc<br>ccgctggctggatgccagaacatactctgacccactggctctgcgcgaat<br>tcaaagagttcgcagcaggaagaagaagcgtctcaggtgacctaatatta<br>gaaatagggaaacttccacaacatttaacgcaaagggcccagaacgcctt<br>ggacaatctggttatgttgcacaactctgaacaaggaggaaaagcctata<br>gacacgccatggaagaactaccagacaccatagaaacgttaatgctccta<br>gctttgatagctgtgctgactggtggagtgacgttgttcttcctatcagg<br>aaggggtctaggaaaaacatccattggcctactctgcgtgattgcctcaa<br>gtgcactgttatggatggccagtgtggaaccccattggatagcggcctct<br>atcatactggagttctttctgatggtgttgcttattccagagccggacag<br>acagcgcactccacaagacaaccagctagcatacgtggtgataggtctgt<br>tattcatgatattgacagtggcagccaatgagatgggattactggaaacc<br>acaaagaaggacctggggattggtcatgcagctgctgaaaaccaccatca<br>tgctgcaatgctggacgtagacctacatccagcttcagcctggactctct<br>atgcagtggccacaacaattatcactcccatgatgagacacacaattgaa<br>aacacaacggcaaatatttccctgacagctattgcaaaccaggcagctat<br>attgatgggacttgacaagggatggccaatatcaaagatggacataggag<br>ttccacttctcgccttggggtgctattctcaggtgaacccgctgacgctg<br>acagcggcggtattgatgctagtggctcattatgccataattggacccgg<br>actgcaagcaaaagctactagagaagctcaaaaaaggacagcagccggaa<br>taatgaaaaacccaactgtcgacgggatcgttgcaatagatttggaccct<br>gtggtttacgatgcaaaatttgaaaaacagctaggccaaataatgttgtt<br>gatactttgcacatcacagatcctcctgatgcggaccacatgggccttgt<br>gtgaatccatcacactagccactggacctctgactacgctttgggaggga<br>tctccaggaaaattctggaacaccacgatagcggtgtccatggcaaacat<br>tttttaggggaagttatctagcaggagcaggtctggccttttcattaatga<br>aatctctaggaggaggtaggagaggcacgggagcccaaggggaaacactg<br>ggagaaaaatggaaaagacagctaaaccaattgagcaagtcagaattcaa<br>cacttacaaaaggagtgggattatagaggtggatagatctgaagccaaag<br>aggggttaaaaagaggagaaacgactaaacacgcagtgtcgagaggaacg<br>gccaaactgaggtggtttgtggagaggaaccttgtgaaaccagaagggaa<br>agtcatagacctcggttgtggaagaggtggctggtcatattattgcgctg<br>ggctgaagaaagtcacagaagtgaaaggatacacgaaaggaggacctgga<br>catgaggaaccaatcccaatggcaacctatggatggaacctagtaaagct<br>atactccgggaaagatgtattctttacaccacctgagaaatgtgacaccc<br>tcttgtgtgatattggtgagtcctctccgaacccaactatagaagaagga<br>agaacgttacgtgttctaaagatggtggaaccatggctcagaggaaacca<br>attttgcataaaaattctaaatccctatatgccgagtgtggtagaaactt<br>tggagcaaatgcaaagaaaacatggaggaatgctagtgcgaaatccactc<br>tcaagaaactccactcatgaaatgtactgggtttcatgtggaacaggaaa<br>cattgtgtcagcagtaaacatgacatctagaatgctgctaaatcgattca<br>caatggctcacaggaagccaacatatgaaagagacgtggacttaggcgct<br>ggaacaagacatgtggcagtagaaccagaggtggccaacctagatatcat<br>tggccagaggatagagaatataaaaaatgaacacaaatcaacatggcatt<br>atgatgaggacaatccatacaaaacatgggcctatcatggatcatatgag<br>gtcaagccatcaggatcagcctcatccatggtcaatggtgtggtgagact<br>gctaaccaaaccatgggatgtcattcccatggtcacacaaatagccatga<br>ctgacaccacaccctttggacaacagagggtgtttaaagagaaagttgac<br>acgcgtacaccaaaagcgaaacgaggcacagcacaaattatggaggtgac<br>agccaggtggttatggggtttctctctagaaacaaaaaacccagaatct<br>gcacaagagaggagttcacaagaaaagtcaggtcaaacgcagctattgga<br>gcagtgttcgttgatgaaaatcaatggaactcagcaaaagaggcagtgga<br>agatgaacggttctgggaccttgtgcacagagagagggagcttcataaac<br>aaggaaaatgtgccacgtgtgtctacaacatgatgggaaagagagagaaa<br>aaattaggagagttcggaaaggcaaaaggaagtcgcgcaatatggtacat<br>gtggttgggagcgcgctttttagagtttgaagcccttggtttcatgaatg<br>aagatcactggttcagcagagagaattcactcagtggagtggaaggagaa<br>ggactccacaaacttggatacatactcagagacatatcaaagattccagg<br>gggaaatatgtatgcagatgacacagccggatgggacacaagaataacag<br>aggatgatcttcagaatgaggccaaaatcactgacatcatggaacctgaa<br>catgccctattggccacgtcaatctttaagctaacctaccaaaacaaggt<br>agtaagggtgcagagaccagcgaaaaatggaaccgtgatggatgtcatat<br>ccagacgtgaccagagaggaagtggacaggttggaacctatggcttaaac<br>accttcaccaacatggaggcccaactaataagacaaatggagtctgaggg<br>aatcttttcacccagcgaattggaaaccccaaatctagccgaaagagtcc<br>tcgactggttgaaaaaacatggcaccgagaggctgaaaagaatggcaatc<br>agtggagatgactgtgtggtgaaaccaatcgatgacagatttgcaacagc | |

TABLE 13-continued

DENV polynucleotide sequences and amino acid sequences

| Name | Sequence | SEQ ID NO |
|---|---|---|
| | cttaacagctttgaatgacatgggaaaggtaagaaaagacataccgcaat<br>gggaaccttcaaaaggatggaatgattggcaacaagtgcctttctgttca<br>caccatttccaccagctgattatgaaggatgggagggagatagtggtgcc<br>atgccgcaaccaagatgaacttgtaggtagggccagagtatcacaaggcg<br>ccggatggagcttgagagaaactgcatgcctaggcaagtcatatgcacaa<br>atgtggcagctgatgtacttccacaggagagacttgagattagcggctaa<br>tgctatctgttcagccgttccagttgattgggtcccaaccagccgcacca<br>cctggtcgatccatgcccaccatcaatggatgacaacagaagacatgttg<br>tcagtgtggaatagggtttggatagaggaaaacccatggatggaggacaa<br>gactcatgtgtccagttgggaagacgttccatacctaggaaaaagggaag<br>atcaatggtgtggttccctaataggcttaacagcacgagccacctgggcc<br>accaacatacaagtggccataaaccaagtgagaaggctcattgggaatga<br>gaattatctagacttcatgacatcaatgaagagattcaaaaacgagagtg<br>atcccgaaggggcactctggtaagccaactcattcacaaaataaaggaaa<br>ataaaaaatcaaacaaggcaagaagtcaggccggattaagccatagcacg<br>gtaagagctatgctgcctgtgagccccgtccaaggacgtaaaatgaagtc<br>aggccgaaagccacggttcgagcaagccgtgctgcctgtagctccatcgt<br>ggggatgtaaaaacccgggaggctgcaaaccatggaagctgtacgcatgg<br>ggtagcagactagtggttagaggagacccctcccaagacacaacgcagca<br>gcggggcccaacaccaggggaagctgtaccctggtggtaaggactagagg<br>ttagaggagacccccgcacaacaacaaacagcatattgacgctgggaga<br>gaccagagatcctgctgtctctacagcatcattccaggcacagaacgcca<br>aaaaatggaatggtgctgttgaatcaacaggttct | |
| DEN-2 (NC_001474.2) | MNNQRKKAKNTPFNMLKRERNRVSTVQQLTKRFSLGMLQGRGPLKLFMAL<br>VAFLRFLTIPPTAGILKRWGTIKKSKAINVLRGFRKEIGRMLNILNRRRR<br>SAGMIIMLIPTVMAFHLTTRNGEPHMIVSRQEKGKSLLFKTEDGVNMCTL<br>MAMDLGELCEDTITYKCPLLRQNEPEDIDCWCNSTSTWVTYGTCTTMGEH<br>RREKRSVALVPHVGMGLETRTETWMSSEGAWKHVQRIETWILRHPGFTMM<br>AAILAYTIGTTHFQRALIFILLTAVTPSMTMRCIGMSNRDFVEGVSGGSW<br>VDIVLEHGSCVTTMAKNKPTLDFELIKTEAKQPATLRKYCIEAKLTNTTT<br>ESRCPTQGEPSLNEEQDKRFVCKHSMVDRGWGNGCGLFGKGGIVTCAMFR<br>CKKNMEGKVVQPENLEYTIVITPHSGEEHAVGNDTGKHGKEIKITPQSSI<br>TEAELTGYGTVTMECSPRTGLDFNEMVLLQMENKAWLVHRQWFLDLPLPW<br>LPGADTQGSNWIQKETLVTFKNPHAKKQDVVVLGSQEGAMHTALTGATEI<br>QMSSGNLLFTGHLKCRLRMDKLQLKGMSYSMCTGKFKVVKEIAETQHGTI<br>VIRVQYEGDGSPCKIPFEIMDLEKRHVLGRLITVNPIVTEKDSPVNIEAE<br>PPFGDSYIIIGVEPGQLKLNWFKKGSSIGQMFETTMRGAKRMAILGDTAW<br>DFGSLGGVFTSIGKALHQVFGAIYGAAFSGVSWTMKILIGVIITWIGMNS<br>RSTSLSVTLVLVGIVTLYLGVMVQADSGCVVSWKNKELKCGSGIFITDNV<br>HTWTEQYKFQPESPSKLASAIQKAHEEGICGIRSVTRLENLMWKQITPEL<br>NHILSENEVKLTIMTGDIKGIMQAGKRSLRPQPTELKYSWKTWGKAKMLS<br>TESHNQTFLIDGPETAECPNTNRAWNSLEVEDYGFGVFTTNIWLKLKEKQ<br>DVFCDSKLMSAAIKDNRAVHADMGYWIESALNDTWKIEKASFIEVKNCHW<br>PKSHTLWSNGVLESEMIIPKNLAGPVSQHNYRPGYHTQITGPWHLGKLEM<br>DFDFCDGTTVVVTEDCGNRGPSLRTTTASGKLITEWCCRSCTLPPLRYRG<br>EDGCWYGMEIRPLKEKEENLVNSLVTAGHGQVDNFSLGVLGMALFLEEML<br>RTRVGTKHAILLVAVSFVTLITGNMSFRDLGRVMVMVGATMTDDIGMGVT<br>YLALLAAFKVRPTFAAGLLLRKLTSKELMMTTIGIVLLSQSTIPETILEL<br>TDALALGMMVLKMVRNMEKYQLAVTIMAILCVPILQNAWKVSCTILAVVS<br>VSPLLLTSSQQKTDWIPLALTIKGLNPTAIFLTTLSRTSKKRSWPLNEAI<br>MAVGMVSILASSLLKNDIPMTGPLVAGGLLTVCYVLTGRSADLELERAAD<br>VKWEDQAEISGSSPILSITISEDGSMSIKNEEEEQTLTILIRTGLLVISG<br>LFPVSIPITAAAWYLWEVKKQRAGVLWDVPSPPPMGKAELEDGAYRIKQK<br>GILGYSQIGAGVYKEGTFHTMWHVTRGAVLMHKGKRIEPSWADVKKDLIS<br>YGGGWKLEGEWKEGEEVQVLALEPGKNPRAVQTKPGLFKTNAGTIGAVSL<br>DFSPGTSGSPIIDKKGKVVGLYGNGVVTRSGAYVSAIAQTEKSIEDNPEI<br>EDDIFRKRRLTIMDLHPGAGKTKRYLPAIVREAIKRGLRTLILAPTRVVA<br>AEMEEALRGLPIRYQTPAIRAEHTGREIVDLMCHATFTMRLLSPVRVPNY<br>NLIIMDEAHFTDPASIAARGYISTRVEMGEAAGIFMTATPPGSRDPFPQS<br>NAPIIDEEREIPERSWNSGHEWVTDFKGKTVWFVPSIKAGNDIAACLRKN<br>GKKVIQLSRKTFDSEYVKTRTNDWDFVVTTDISEMGANFKAERVIDPRRC<br>MKPVILTDGEERVILAGPMPVTHSSAAQRRGRIGRNPKNENDQYIYMGEP<br>LENDEDCAHWKEAKMLLDNINTPEGIIPSMFEPEREKVDAIDGEYRLRGE<br>ARKTFVDLMRRGDLPVWLAYRVAAEGINYADRRWCFDGVKNNQILEENVE<br>VEIWTKEGERKKLKPRWLDARIYSDPLALKEFKEFAAGRKSLTLNLITEM<br>GRLPTFMTQKARDALDNLAVLHTAEAGGRAYNHALSELPETLETLLLLTL<br>LATVTGGIFLFLMSGRGIGKMTLGMCCIITASILLWYAQIQPHWIAASII<br>LEFFLIVLLIPEPEKQRTPQDNQLTYVVIAILTVVAATMANEMGFLEKTK<br>KDLGLGSIATQQPESNILDIDLRPASAWTLYAVATTFVTPMLRHSIENSS<br>VNVSLTAIANQATVLMGLGKGWPLSKMDIGVPLLAIGCYSQVNPITLTAA<br>LFLLVAHYAIIGPGLQAKATREAQKRAAAGIMKNPTVDGITVIDLDPIPY<br>DPKFEKQLGQVMLLVLCVTQVLMMRTTWALCEALTLATGPISTLWEGNPG<br>RFWNTTIAVSMANIFRGSYLAGAGLLFSIMKNTTNTRRGTGNIGETLGEK<br>WKSRLNALGKSEFQIYKKSGIQEVDRTLAKEGIKR | 17 |

TABLE 13-continued

DENV polynucleotide sequences and amino acid sequences

| Name | Sequence | SEQ ID NO |
|---|---|---|
| | GETDHHAVSRGSAKLRWFVERNMVTPEGKVVDLGCGRGGWSYYCGGLKNV<br>REVKGLTKGGPGHEEPIPMSTYGWNLVRLQSGVDVFFIPPEKCDTLLCDI<br>GESSPNPTVEAGRTLRVLNLVENWLNNNTQFCIKVLNPYMPSVIEKMEAL<br>QRKYGGALVRNPLSRNSTHEMYWVSNASGNIVSSVNMISRMLINRFTMRY<br>KKATYEPDVDLGSGTRNIGIESEIPNLDIIGKRIEKIKQEHETSWHYDQD<br>HPYKTWAYHGSYETKQTGSASSMVNGVVRLLTKPWDVVPMVTQMAMTDTT<br>PFGQQRVFKEKVDTRTQEPKEGTKKLMKITAEWLWKELGKKKTPRMCTRE<br>EFTRKVRSNAALGAIFTDENKWKSAREAVEDSRFWELVDKERNLHLEGKC<br>ETCVYNMMGKREKKLGEFGKAKGSRAIWYMWLGARFLEFEALGFLNEDHW<br>FSRENSLSGVEGEGLHKLGYILRDVSKKEGGAMYADDTAGWDTRITLEDL<br>KNEEMVTNHMEGEHKKLAEAIFKLTYQNKVVRVQRPTPRGTVMDIISRRD<br>QRGSGQVGTYGLNTFTNMEAQLIRQMEGEGVFKSIQHLTITEEIAVQNWL<br>ARVGRERLSRMAISGDDCVVKPLDDRFASALTALNDMGKIRKDIQQWEPS<br>RGWNDWTQVPFCSHHFHELIMKDGRVLVVPCRNQDELIGRARISQGAGWS<br>LRETACLGKSYAQMWSLMYFHRRDLRLAANAICSAVPSHWVPTSRTTWSI<br>HAKHEWMTTEDMLTVWNRVWIQENPWMEDKTPVESWEEIPYLGKREDQWC<br>GSLIGLTSRATWAKNIQAAINQVRSLIGNEEYTDYMPSMKRFRREEEEAG<br>VLW | |
| DEN-2<br>(NC_001474.2) | agttgttagtctacgtggaccgacaaagacagattctttgagggagctaa<br>gctcaacgtagttctaacagtttttttaattagagagcagatctctgatga<br>ataaccaacggaaaaaggcgaaaaacacgcctttcaatatgctgaaacgc<br>gagagaaaccgcgtgtcgactgtgcaacagctgacaaagagattctcact<br>tggaatgctgcagggacgaggaccattaaaactgttcatggccctggtgg<br>cgttccttcgtttcctaacaatcccaccaacagcagggatattgaagaga<br>tggggaacaattaaaaaatcaaaagctattaatgttttgagagggttcag<br>gaaagagattggaaggatgctgaacatcttgaataggagacgcagatctg<br>caggcatgatcattatgctgattccaacagtgatggcgttccatttaacc<br>acacgtaacggagaaccacacatgatcgtcagcagacaagagaaagggaa<br>aagtcttctgtttaaaacagaggatggcgtgaacatgtgtaccctcatgg<br>ccatggaccttggtgaattgtgtgaagacacaatcacgtacaagtgtccc<br>cttctcaggcagaatgagccagaagacatagactgttggtgcaactctac<br>gtccacgtgggtaacttatgggacgtgtaccaccatgggagaacatagaa<br>gagaaaaaagatcagtggcactcgttccacatgtgggaatgggactggag<br>acacgaactgaaacatggatgtcatcagaaggggcctggaaacatgtcca<br>gagaattgaaacttggatcttgagacatccaggcttcaccatgatggcag<br>caatcctggcatacaccataggaacgacacatttccaaagagccctgatt<br>ttcatcttactgacagctgtcactccttcaatgacaatgcgttgcatagg<br>aatgtcaaatagagactttgtggaaggggtttcaggaggaagctgggttg<br>acatagtcttagaacatggaagctgtgtgacgacgatggcaaaaaacaaa<br>ccaacattggattttgaactgataaaaacagaagccaaacagcctgccac<br>cctaaggaagtactgtatagaggcaaagctaaccaacacaacaacagaat<br>ctcgctgcccaacacaaggggaacccagcctaaatgaagagcaggacaaa<br>aggttcgtctgcaaacactccatggtagacagaggatggggaaatggatg<br>tggactatttggaaagggaggcattgtgacctgtgctatgttcagatgca<br>aaaagaacatggaaggaaaagttgtgcaaccagaaaacttggaatacacc<br>attgtgataacacctcactcaggggaagagcatgcagtcggaaatgacac<br>aggaaaacatggcaaggaaatcaaaataacaccacagagttccatcacag<br>aagcagaattgacaggttatggcactgtcacaatggagtgctctccaaga<br>acgggcctcgacttcaatgagatggtgttgctgcagatggaaaataaagc<br>ttggctggtgcacaggcaatggttcctagacctgccgttaccatggttgc<br>ccggagcggacacacaagggtcaaattggatacagaaagagacattggtc<br>actttcaaaaatccccatgcgaagaaacaggatgttgttgttttaggatc<br>ccaagaaggggccatgcacacagcacttacaggggccacagaaatccaaa<br>tgtcatcaggaaacttactcttcacaggacatctcaagtgcaggctgaga<br>atggacaagctacagctcaaaggaatgtcatactctatgtgcacaggaaa<br>gtttaaagttgtgaaggaaatagcagaaacacaacatggaacaatagtta<br>tcagagtgcaatatgaaggggacggctctccatgcaagatcccttttgag<br>ataatggatttggaaaaaagacatgtcttaggtcgcctgattacagtcaa<br>cccaattgtgacagaaaaagatagcccagtcaacatagaagcagaacctc<br>cattcggagacagctacatcatcataggagtagagccgggacaactgaag<br>ctcaactggtttaagaaaggaagttctatcggccaaatgtttgagacaac<br>aatgaggggggcgaagagaatggccattttaggtgacacagcctgggatt<br>ttggatccttgggaggagtgtttacatctataggaaaggctctccaccaa<br>gtctttggagcaatctatggagctgccttcagtggggtttcatggactat<br>gaaaatcctcataggagtcattatcacatggataggaatgaattcacgca<br>gcacctcactgtctgtgacactagtattggtgggaattgtgacactgtat<br>ttgggagtcatggtgcaggccgatagtggttgcgttgtgagctggaaaaa<br>caaagaactgaaatgtggcagtgggattttcatcacagacaacgtgcaca<br>catggacagaacaatacaagttccaaccagaatccccttcaaaactagct<br>tcagctatccagaaagcccatgaagagggcatttgtggaatccgctcagt<br>aacaagactggagaatctgatgtggaaacaaataacaccagaattgaatc<br>acattctatcagaaaatgaggtgaagttaactattatgacaggagacatc<br>aaaggaatcatgcaggcaggaaaacgatctctgcggcctcagcccactga<br>gctgaagtattcatggaaaacatggggcaaagcaaaaatgctctctacag | 18 |

TABLE 13-continued

DENV polynucleotide sequences and amino acid sequences

| Name | Sequence | SEQ ID NO |
| --- | --- | --- |
| | agtctcataaccagacctttctcattgatggccccgaaacagcagaatgc<br>cccaacacaaatagagcttggaattcgttggaagttgaagactatggctt<br>tggagtattcaccaccaatatatggctaaaattgaaagaaaaacaggatg<br>tattctgcgactcaaaactcatgtcagcggccataaaagacaacagagcc<br>gtccatgccgatatgggttattggatagaaagtgcactcaatgacacatg<br>gaagatagagaaagcctctttcattgaagttaaaaactgccactggccaa<br>aatcacacaccctctggagcaatggagtgctagaaagtgagatgataatt<br>ccaaagaatctcgctggaccagtgtctcaacacaactatagaccaggcta<br>ccatacacaaataacaggaccatggcatctaggtaagcttgagatggact<br>ttgatttctgtgatggaacaacagtggtagtgactgaggactgcggaaat<br>agaggaccctctttgagaacaaccactgcctctggaaaactcataacaga<br>atggtgctgccgatcttgcacattaccaccgctaagatacagaggtgagg<br>atgggtgctggtacgggatggaaatcagaccattgaaggagaaagaagag<br>aatttggtcaactccttggtcacagctggacatgggcaggtcgacaactt<br>ttcactaggagtcttgggaatggcattgttcctggaggaaatgcttagga<br>cccgagtaggaacgaaacatgcaatactactagttgcagtttcttttgtg<br>acattgatcacagggaacatgtcctttagagacctgggaagagtgatggt<br>tatggtaggcgccactatgacggatgacataggtatgggcgtgacttatc<br>ttgccctactagcagccttcaaagtcagaccaacttttgcagctggacta<br>ctcttgagaaagctgacctccaaggaattgatgatgactactataggaat<br>tgtactcctctcccagagcaccataccagagaccattcttgagttgactg<br>atgcgttagccttaggcatgatggtcctcaaaatggtgagaaatatggaa<br>aagtatcaattggcagtgactatcatggctatcttgtgcgtcccaaacgc<br>agtgatattacaaaacgcatggaaagtgagttgcacaatattggcagtgg<br>tgtccgtttccccactgctcttaacatcctcacagcaaaaaacagattgg<br>ataccattagcattgacgatcaaaggtctcaatccaacagctatttttct<br>aacaaccctctcaagaaccagcaagaaaaggagctggccattaaatgagg<br>ctatcatggcagtcgggatggtgagcattttagccagttctctcctaaaa<br>aatgatattcccatgacaggaccattagtggctggagggctcctcactgt<br>gtgctacgtgctcactggacgatcggccgatttggaactggagagagcag<br>ccgatgtcaaatgggaagaccaggcagagatatcaggaagcagtccaatc<br>ctgtcaataacaatatcagaagatggtagcatgtcgataaaaaatgaaga<br>ggaagaacaaacactgaccatactcattagaacaggattgctggtgatct<br>caggactttttcctgtatcaataccaatcacggcagcagcatggtacctg<br>tgggaagtgaagaaacaacgggccggagtattgtgggatgttccttcacc<br>cccacccatgggaaaggctgaactggaagatggagcctatagaattaagc<br>aaaaagggattcttggatattcccagatcggagccggagtttacaaagaa<br>ggaacattccatacaatgtggcatgtcacacgtggcgctgttctaatgca<br>taaaggaaagaggattgaaccatcatgggcggacgtcaagaaagacctaa<br>tatcatatggaggaggctggaagttagaaggagaatggaaggaaggagaa<br>gaagtccaggtattggcactggagcctggaaaaaatccaagagccgtcca<br>aacgaaacctggtcttttcaaaaccaacgccggaacaataggtgctgtat<br>ctctggacttttctcctggaacgtcaggatctccaattatcgacaaaaaa<br>ggaaaagttgtgggtctttatggtaatggtgttgttacaaggagtggagc<br>atatgtgagtgctatagcccagactgaaaaaagcattgaagacaacccag<br>agatcgaagatgacattttccgaaagagaagactgaccatcatggacctc<br>cacccaggagcgggaaagacgaagagataccttccggccatagtcagaga<br>agctataaaacggggtttgagaacattaatcttggcccccactagagttg<br>tggcagctgaaatggaggaagcccttagaggacttccaataagataccag<br>accccagccatcagagctgagcacaccgggcgggagattgtggacctaat<br>gtgtcatgccacatttaccatgaggctgctatcaccagttagagtgccaa<br>actacaacctgattatcatggacgaagcccatttcacagacccagcaagt<br>atagcagctagaggatacatctcaactcgagtggagatgggtgaggcagc<br>tgggatttttatgacagccactcccccgggaagcagagacccatttcctc<br>agagcaatgcaccaatcatagatgaagaaagagaaatccctgaacgttcg<br>tggaattccggacatgaatgggtcacggattttaaagggaagactgtttg<br>gttcgttccaagtataaaagcaggaaatgatatagcagcttgcctgagga<br>aaaatggaaagaaagtgatacaactcagtaggaagacctttgattctgag<br>tatgtcaagactagaaccaatgattgggacttcgtggttacaactgacat<br>ttcagaaatgggtgccaatttcaaggctgagagggttatagaccccagac<br>gctgcatgaaaccagtcatactaacagatggtgaagagcgggtgattctg<br>gcaggacctatgccagtgacccactctagtgcagcacaaagaagagggag<br>aataggaagaaatccaaaaaatgagaatgaccagtacatatacatggggg<br>aacctctggaaaatgatgaagactgtgcacactggaaagaagctaaaatg<br>ctcctagataacatcaacacgccagaaggaatcattcctagcatgttcga<br>accagagcgtgaaaaggtggatgccattgatggcgaataccgcttgagag<br>gagaagcaaggaaaacctttgtagacttaatgagaagaggagacctacca<br>gtctggttggcctacagagtggcagctgaaggcatcaactacgcagacag<br>aaggtggtgttttgatggagtcaagaacaaccaaatcctagaagaaaacg<br>tggaagttgaaatctggacaaaagaaggggaaaggaagaaattgaaaccc<br>agatggttggatgctaggatctattctgacccactggcgctaaaagaatt<br>taaggaatttgcagccggaagaaagtctctgaccctgaacctaatcacag<br>aaatgggtaggctcccaaccttcatgactcagaaggcaagagacgcactg<br>gacaacttagcagtgctgcacacggctgaggcaggtggaagggcgtacaa<br>ccatgctctcagtgaactgccggagaccctggagacattgcttttactga | |

TABLE 13-continued

DENV polynucleotide sequences and amino acid sequences

| Name | Sequence | SEQ ID NO |
|---|---|---|
| | cacttctggctacagtcacgggagggatctttttattcttgatgagcgga | |
| | aggggcatagggaagatgaccctgggaatgtgctgcataatcacggctag | |
| | catcctcctatggtacgcacaaatacagccacactggatagcagcttcaa | |
| | taatactggagtttttctcatagttttgcttattccagaacctgaaaaa | |
| | cagagaacaccccaagacaaccaactgacctacgttgtcatagccatcct | |
| | cacagtggtggccgcaaccatggcaaacgagatgggtttcctagaaaaaa | |
| | cgaagaaagatctcggattgggaagcattgcaacccagcaacccgagagc | |
| | aacatcctggacatagatctacgtcctgcatcagcatggacgctgtatgc | |
| | cgtggccacaacatttgttacaccaatgttgagacatagcattgaaaatt | |
| | cctcagtgaatgtgtccctaacagctatagccaaccaagccacagtgtta | |
| | atgggtctcgggaaaggatggccattgtcaaagatggacatcggagttcc | |
| | ccttctcgccattggatgctactcacaagtcaaccccataactctcacag | |
| | cagctcttttcttattggtagcacattatgccatcatagggccaggactc | |
| | caagcaaaagcaaccagagaagctcagaaaagagcagcggcgggcatcat | |
| | gaaaaacccaactgtcgatggaataacagtgattgacctagatccaatac | |
| | cttatgatccaaagtttgaaaagcagttgggacaagtaatgctcctagtc | |
| | ctctgcgtgactcaagtattgatgatgaggactacatgggctctgtgtga | |
| | ggctttaaccttagctaccgggcccatctccacattgtgggaaggaaatc | |
| | cagggaggttttggaacactaccattgcggtgtcaatggctaacattttt | |
| | agagggagttacttggccggagctggacttctcttttctattatgaagaa | |
| | cacaaccaacacaagaaggggaactggcaacataggagagacgcttggag | |
| | agaaatggaaaagccgattgaacgcattgggaaaaagtgaattccagatc | |
| | tacaagaaaagtggaatccaggaagtggatagaaccttagcaaaagaagg | |
| | cattaaaagaggagaaacggaccatcacgctgtgtcgcgaggctcagcaa | |
| | aactgagatggttcgttgagagaaacatggtcacaccagaagggaaagta | |
| | gtggacctcggttgtggcagaggaggctggtcatactattgtggaggact | |
| | aaagaatgtaagagaagtcaaaggcctaacaaaaggaggaccaggacacg | |
| | aagaacccatccccatgtcaacatatgggtggaatctagtgcgtcttcaa | |
| | agtggagttgacgttttcttcatcccgccagaaaagtgtgacacattatt | |
| | gtgtgacataggggagtcatcaccaaatcccacagtggaagcaggacgaa | |
| | cactcagagtccttaacttagtagaaaattggttgaacaacaacactcaa | |
| | ttttgcataaaggttctcaacccatatatgccctcagtcatagaaaaaat | |
| | ggaagcactacaaaggaaatatggaggagccttagtgaggaatccactct | |
| | cacgaaactccacacatgagatgtactgggtatccaatgcttccgggaac | |
| | atagtgtcatcagtgaacatgatttcaaggatgttgatcaacagatttac | |
| | aatgagatacaagaaagccacttacgagccggatgttgacctcggaagcg | |
| | gaacccgtaacatcgggattgaaagtgagataccaaacctagatataatt | |
| | gggaaaagaatagaaaaaataaagcaagagcatgaaacatcatggcacta | |
| | tgaccaagaccacccatacaaaacgtgggcataccatggtagctatgaaa | |
| | caaaacagactggatcagcatcatccatggtcaacggagtggtcaggctg | |
| | ctgacaaaaccttgggacgtcgtccccatggtgacacagatggcaatgac | |
| | agacacgactccatttggacaacagcgcgtttttaaagagaaagtggaca | |
| | cgagaacccaagaaccgaaagaaggcacgaagaaactaatgaaaataaca | |
| | gcagagtggctttggaaagaattagggaagaaaaagacacccaggatgtg | |
| | caccagagaagaattcacaagaaaggtgagaagcaatgcagccttggggg | |
| | ccatattcactgatgagaacaagtggaagtcggcacgtgaggctgttgaa | |
| | gatagtaggttttgggagctggttgacaaggaaaggaatctccatcttga | |
| | aggaaagtgtgaaacatgtgtgtacaacatgatgggaaaaagagagaaga | |
| | agctaggggaattcggcaaggcaaaaggcagcagagccatatggtacatg | |
| | tggcttggagcacgcttcttagagtttgaagccctaggattcttaaatga | |
| | agatcactggttctccagagagaactccctgagtggagtggaaggagaag | |
| | ggctgcacaagctaggttacattctaagagacgtgagcaagaaagaggga | |
| | ggagcaatgtatgccgatgacaccgcaggatgggatacaagaatcacact | |
| | agaagacctaaaaaatgaagaaatggtaacaaaccacatggaaggagaac | |
| | acaagaaactagccgaggccattttcaaactaacgtaccaaaacaaggtg | |
| | gtgcgtgtgcaaagaccaacaccaagaggcacagtaatggacatcatatc | |
| | gagaagagaccaaagaggtagtggacaagttggcacctatggactcaata | |
| | ctttcaccaatatggaagcccaactaatcagacagatggagggagaagga | |
| | gtctttaaaagcattcagcacctaacaatcacagaagaaatcgctgtgca | |
| | aaactggttagcaagagtggggcgcgaaaggttatcaagaatggccatca | |
| | gtggagatgattgtgttgtgaaacctttagatgacaggttcgcaagcgct | |
| | ttaacagctctaaatgacatgggaaagattaggaaagacatacaacaatg | |
| | ggaaccttcaagaggatggaatgattggacacaagtgcccttctgttcac | |
| | accatttccatgagttaatcatgaaagacggtcgcgtactcgttgttcca | |
| | tgtagaaaccaagatgaactgattggcagagcccgaatctcccaaggagc | |
| | agggtggtctttgcgggagacggcctgtttggggaagtcttacgcccaaa | |
| | tgtggagcttgatgtacttccacagacgcgacctcaggctggcggcaaat | |
| | gctatttgctcggcagtaccatcacattgggttccaacaagtcgaacaac | |
| | ctggtccatacatgctaaacatgaatggatgacaacggaagacatgctga | |
| | cagtctggaacagggtgtggattcaagaaaacccatggatggaagacaaa | |
| | actccagtggaatcatgggaggaaatcccatacttggggaaaagagaaga | |
| | ccaatggtgcggctcattgattgggttaacaagcagggccacctgggcaa | |
| | agaacatccaagcagcaataaatcaagttagatcccttataggcaatgaa | |
| | gaatacacagattacatgccatccatgaaaagattcagaagagaagagga | |
| | agaagcaggagttctgtggtagaaagcaaaactaacatgaaacaaggcta | |

TABLE 13-continued

DENV polynucleotide sequences and amino acid sequences

| Name | Sequence | SEQ ID NO |
|---|---|---|
| | gaagtcaggtcggattaagccatagtacggaaaaaactatgctacctgtg<br>agccccgtccaaggacgttaaaagaagtcaggccatcataaatgccatag<br>cttgagtaaactatgcagcctgtagctccacctgagaaggtgtaaaaaat<br>ccgggaggccacaaaccatggaagctgtacgcatggcgtagtggactagc<br>ggttagaggagacccctcccttacaaatcgcagcaacaatgggggcccaa<br>ggcgagatgaagctgtagtctcgctggaaggactagaggttagaggagac<br>ccccccgaaacaaaaaacagcatattgacgctgggaaagaccagagatcc<br>tgctgtctcctcagcatcattccaggcacagaacgccagaaaatggaatg<br>gtgctgttgaatcaacaggttct | |
| DEN-3<br>(NC_001475.2) | MNNQRKKTGKPSINMLKRVRNRVSTGSQLAKRFSKGLLNGQGPMKLVMAF<br>IAFLRFLAIPPTAGVLARWGTFKKSGAIKVLKGFKKEISNMLSIINQRKK<br>TSLCLMMILPAALAFHLTSRDGEPRMIVGKNERGKSLLFKTASGINMCTL<br>IAMDLGEMCDDTVTYKCPHITEVEPEDIDCWCNLTSTWVTYGTCNQAGEH<br>RRDKRSVALAPHVGMGLDTRTQTWMSAEGAWRQVEKVETWALRHPGFTIL<br>ALFLAHYIGTSLTQKVVIFILLMLVTPSMTMRCVGVGNRDFVEGLSGATW<br>VDVVLEHGGCVTTMAKNKPTLDIELQKTEATQLATLRKLCIEGKITNITT<br>DSRCPTQGEAVLPEEQDQNYVCKHTYVDRGWGNGCGLFGKGSLVTCAKFQ<br>CLEPIEGKVVQYENLKYTVIITVHTGDQHQVGNETQGVTAEITPQASTTE<br>AILPEYGTLGLECSPRTGLDFNEMILLTMKNKAWMVHRQWFFDLPLPWAS<br>GATTETPTWNRKELLVTFKNAHAKKQEVVVLGSQEGAMHTALTGATEIQN<br>SGGTSIFAGHLKCRLKMDKLELKGMSYAMCTNTFVLKKEVSETQHGTILI<br>KVEYKGEDAPCKIPFSTEDGQGKAHNGRLITANPVVTKKEEPVNIEAEPP<br>FGESNIVIGIGDNALKINWYKKGSSIGKMFEATERGARRMAILGDTAWDF<br>GSVGGVLNSLGKMVHQIFGSAYTALFSGVSWVMKIGIGVLLTWIGLNSKN<br>TSMSFSCIAIGIITLYLGAVVQADMGCVINWKGKELKCGSGIFVTNEVHT<br>WTEQYKFQADSPKRLATAIAGAWENGVCGIRSTTRMENLLWKQIANELNY<br>ILWENNIKLTVVVGDTLGVLEQGKRTLTPQPMELKYSWKTWGKAKIVTAE<br>TQNSSFIIDGPNTPECPSASRAWNVWEVEDYGFGVFTTNIWLKLREVYTQ<br>LCDHRLMSAAVKDERAVHADMGYWIESQKNGSWKLEKASLIEVKTCTWPK<br>SHTLWTNGVLESDMIIPKSLAGPISQHNYRPGYHTQTAGPWHLGKLELDF<br>NYCEGTTVVITESCGTRGPSLRTTTVSGKLIHEWCCRSCTLPPLRYMGED<br>GCWYGMEIRPISEKEENMVKSLVSAGSGKVDNFTMGVLCLAILFEEVLRG<br>KFGKKHMIAGVFFTFVLLLSGQITWRDMAHTLIMIGSNASDRMGMGVTYL<br>ALIATFKIQPFLALGFFLRKLTSRENLLLGVGLAMATTLQLPEDIEQMAN<br>GVALGLMALKLITQFETYQLWTALVSLTCSNTIFTLTVAWRTATLILAGV<br>SLLPVCQSSSMRKTDWLPMTVAAMGVPPLPLFIFSLKDTLKRRSWPLNEG<br>VMAVGLVSILASSLLRNDVPMAGPLVAGGLLIACYVITGTSADLTVEKAP<br>DVTWEEEAEQTGVSHNLMITVDDDGTMRIKDDETENILTVLLKTALLIVS<br>GIFPYSIPATLLVWHTWQKQTQRSGVLWDVPSPPETQKAELEEGVYRIKQ<br>QGIFGKTQVGVGVQKEGVFHTMWHVTRGAVLTHNGKRLEPNWASVKKDLI<br>SYGGGWRLSAQWQKGEEVQVIAVEPGKNPKNFQTTPGTFQTTTGEIGAIA<br>LDFKPGTSGSPIINREGKVVGLYGNGVVTKNGGYVSGIAQTNAEPDGPTP<br>ELEEEMFKKRNLTIMDLHPGSGKTRKYLPAIVREAIKRRLRTLILAPTRV<br>VAAEMEEALKGLPIRYQTTATKSEHTGREIVDLMCHATFTMRLLSPVRVP<br>NYNLIIMDEAHFTDPASIAARGYISTRVGMGEAAAIFMTATPPGTADAFP<br>QSNAPIQDEERDIPERSWNSGNEWITDFAGKTVWFVPSIKAGNDIANCLR<br>KNGKKVIQLSRKTFDTEYQKTKLNDWDFVVTTDISEMGANFKADRVIDPR<br>RCLKPVILTDGPERVILAGPMPVTAASAAQRRGRVGRNPQKENDQYIFTG<br>QPLNNDEDHAHWTEAKMLLDNINTPEGIIPALFEPEREKSAAIDGEYRLK<br>GESRKTFVELMRRGDLPVWLAHKVASEGIKYTDRKWCFDGQRNNQILEEN<br>MDVEIWTKEGEKKKLRPRWLDARTYSDPLALKEFKDFAAGRKSIALDLVT<br>ElGRVPSHLAHRTRNALDNLVMLHTSEDGGRAYRHAVEELPETMETLLLL<br>GLMILLTGGAMLFLISGKGIGKTSIGLICVIASSGMLWMAEVPLQWIASA<br>IVLEFFMMVLLIPEPEKQRTPQDNQLAYVVIGILTLAATIAANEMGLLET<br>TKRDLGMSKEPGVVSPTSYLDVDLHPASAWTLYAVATTVITPMLRHTIEN<br>STANVSLAAIANQAVVLMGLDKGWPISKMDLGVPLLALGCYSQVNPLTLT<br>AAVLLLITHYAIIGPGLQAKATREAQKRTAAGIMKNPTVDGIMTIDLDSV<br>IFDSKFEKQLGQVMLLVLCAVQLLLMRTSWALCEALTLATGPITTLWEGS<br>PGKFWNTTIAVSMANIFRGSYLAGAGLAFSIMKSVGTGKRGTGSQGETLG<br>EKWKKKLNQLSRKEFDLYKKSGITEVDRTEAKEGLKRGETTHHAVSRGSA<br>KLQWFVERNMVVPEGRVIDLGCGRGGWSYYCAGLKKVTEVRGYTKGGPGH<br>EEPVPMSTYGWNIVKLMSGKDVFYLPPEKCDTLLCDIGESSPSPTVEESR<br>TIRVLKMVEPWLKNNQFCIKVLNPYMPTVIEHLERLQRKHGGMLVRNPLS<br>RNSTHEMYWISNGTGNIVSSVNMVSRLLLNRFTMTHRRPTIEKDVDLGAG<br>TRHVNAEPETPNMDVIGERIKRIKEEHNSTWHYDDENPYKTWAYHGSYEV<br>KATGSASSMINGVVKLLTKPWDVVPMVTQMAMTDTTPFGQQRVFKEKVDT<br>RTPRPMPGTRKAMEITAEWLWRTLGRNKRPRLCTREEFTKKVRTNAAMGA<br>VFTEENQWDSAKAAVEDEEFWKLVDRERELHKLGKCGSCVYNMMGKREKK<br>LGEFGKAKGSRAIWYMWLGARYLEFEALGFLNEDHWFSRENSYSGVEGEG<br>LH<br>KLGYILRDISKIPGGAMYADDTAGWDTRITEDDLHNEEKIIQQMDPEHRQ<br>LANAIFKLTYQNKVVKVQRPTPTGTVMDIISRKDQRGSGQLGTYGLNTFT<br>NMEAQLVRQMEGEGVLTKADLENPHLLEKKITQWLETKGVERLKRMAISG<br>DDCVVKPIDDRFANALLALNDMGKVRKDIPQWQPSKGWHDWQQVPFCSHH | 19 |

TABLE 13-continued

DENV polynucleotide sequences and amino acid sequences

| Name | Sequence | SEQ ID NO |
|---|---|---|
| | FHELIMKDGRKLVVPCRPQDELIGRARISQGAGWSLRETACLGKAYAQMW<br>SLMYFHRRDLRLASNAICSAVPVHWVPTSRTTWSIHAHHQWMTTEDMLTV<br>WNRVWIEENPWMEDKTPVTTWENVPYLGKREDQWCGSLIGLTSRATWAQN<br>IPTAIQQVRSLIGNEEFLDYMPSMKRFRKEEESEGAIW | |
| DEN-3<br>(NC_001475.2) | agttgttagtctacgtggaccgacaagaacagtttcgactcggaagcttg<br>cttaacgtagtgctgacagtttttattagagagcagatctctgatgaac<br>aaccaacggaagaagacgggaaaaccgtctatcaatatgctgaaacgcgt<br>gagaaaccgtgtgtcaactggatcacagttggcgaagagattctcaaaag<br>gactgctgaacggccagggaccaatgaaattggttatggcgttcatagct<br>ttcctcagatttctagccattccaccaacagcaggagtcttggctagatg<br>gggaaccttcaagaagtcgggggccattaaggtcctgaaaggcttcaaga<br>aggagatctcaaacatgctgagcataatcaaccaacggaaaaagacatcg<br>ctctgtctcatgatgatattgccagcagcacttgctttccacttgacttc<br>acgagatggagagccgcgcatgattgtggggaagaatgaaagaggtaaat<br>ccctactttttaagacagcctctggaatcaacatgtgcacactcatagcc<br>atggatttgggagagatgtgtgatgacacggtcacttacaaatgcccccca<br>cattaccgaagtggaacctgaagacattgactgctggtgcaaccttacat<br>caacatgggtgacttatggaacgtgcaatcaagctggagagcatagacgc<br>gacaagagatcagtggcgttagctccccatgtcggcatgggactggacac<br>acgcacccaaacctggatgtcggctgaaggagcttggagacaagtcgaga<br>aggtagagacatgggcccttaggcacccagggttcaccatactagcccta<br>tttctcgcccattacataggcacttccctgacccagaaggtggttatttt<br>catattattaatgctggtcaccccatccatgacaatgagatgtgtgggag<br>taggaaacagagattttgtggaagggctatcaggagctacgtgggttgac<br>gtggtgctcgagcacgggggtgtgtgactaccatggctaagaacaagcc<br>cacgctggatatagagcttcagaagaccgaggccacccaactggcgaccc<br>taaggaagctatgcattgaggggaaaattaccaacataacaactgactca<br>agatgtcctacccaaggggaagcggttttgcctgaggagcaggaccagaa<br>ctacgtgtgtaagcatacatacgtagacagaggttgggggaacggttgtg<br>gtttgtttggcaaaggaagcttggtaacatgtgcgaaatttcaatgcctg<br>gaaccaatagagggaaaagtggtgcaatatgagaacctcaaatacaccgt<br>catcattacagtgcacacaggagaccaacaccaggtgggaaatgaaacgc<br>aaggagtcacggctgagataacacctcaggcatcaaccactgaagccatc<br>ttgcctgaatatggaacccttgggctagaatgctcaccacggacaggttt<br>ggatttcaatgaaatgatcttactaacaatgaagaacaaagcatggatgg<br>tacatagacaatggttctttgacctacctctaccatgggcatcaggagct<br>acaacagaaacaccaacctggaacaggaaggagcttcttgtgacattcaa<br>aaacgcacatgcgaaaaaacaagaagtagttgtccttggatcgcaagagg<br>gagcaatgcataccgcactgacaggagctacagaaatccaaaactcagga<br>ggcacaagcattttcgcggggcacttaaaatgtagacttaagatggacaa<br>attggaactcaaggggatgagctatgcaatgtgcacgaatacctttgtgt<br>tgaagaaagaagtctcagaaacgcagcacgggacaatactcattaaggtt<br>gagtacaaaggggaagatgcaccttgcaagattcccttttccacagagga<br>tggacaagggaaagctcataatggcagactgatcacagccaaccctgtgg<br>tgactaagaaggaggagcctgtcaatattgaggctgaacctccttttggg<br>gaaagcaatatagtaattggaattggagacaacgccttgaaaatcaactg<br>gtacaagaaggggagctcgattgggaagatgttcgaggccactgaaaggg<br>gtgcaaggcgcatggccatcttgggagacacagcttgggactttggatca<br>gtgggtggtgttctgaactcattaggcaaaatggtgcaccaaatatttgg<br>aagtgcttatacagccctgttcagtggagtctcttgggtgatgaaaattg<br>gaataggtgtcctcttgacttggatagggttgaattcaaaaaacacatcc<br>atgtcattttcatgcattgcgataggaatcattacactctatctgggagc<br>tgtggtacaagctgacatggggtgtgtcataaactggaagggcaaagaac<br>tcaaatgtggaagcggaattttcgtcaccaatgaggtccatacctggaca<br>gagcaatacaaattccaagcagactccccaaaaagattggcaacagccat<br>tgcaggcgcctgggagaatggagtgtgtggaattaggtcaacaaccagaa<br>tggagaatctcttgtggaagcaaatagccaatgaactgaactacatatta<br>tgggaaaacaatatcaaattaacggtagttgtgggcgatacacttggggt<br>cttagagcaagggaaaagaacactaacaccacaacccatggagctaaaat<br>actcatggaaaacgtggggaaaggcaaaaatagtgacagctgaaacacaa<br>aattcctctttcataatagacgggccaaacacaccggagtgtccaagtgc<br>ctcaagagcatggaatgtgtgggaggtggaagattacgggttcggagtct<br>tcacaaccaacatatggctgaaactccgagaggtctacacccaactatgt<br>gaccataggctaatgtcggcagctgtcaaggatgagagggccgtgcatgc<br>cgacatgggctactggatagaaagccaaaagaatggaagttggaagctag<br>aaaaagcatccctcatagaggtaaaaacctgcacatggccaaaatcacac<br>actctctggactaatggtgtgctagagagtgacatgatcatcccaaagag<br>tctagctggtcctatctcacaacacaactacaggcccgggtaccacaccc<br>aaacggcaggaccctggcacttaggaaaattggagctggacttcaactac<br>tgtgaaggaacaacagttgtcatcacagaaagctgtgggacaagaggccc<br>atcattgagaacaacaacagtgtcagggaagttgatacacgaatggtgtt<br>gccgctcgtgcacacttccccccctgcgatacatgggagaagacggctgc<br>tggtatggcatggaaatcagacccatcagtgagaaagaagagaacatggt<br>aaagtctttagtctcagcgggaagtggaaaggtggacaacttcacaatgg | 20 |

TABLE 13-continued

DENV polynucleotide sequences and amino acid sequences

| Name | Sequence | SEQ ID NO |
|---|---|---|
| | gtgtcttgtgtttggcaatcctctttgaagaggtgttgagaggaaaattt | |
| | gggaagaaacacatgattgcaggggttttctttacgtttgtgctccttct | |
| | ctcagggcaaataacatggagagacatggcgcacacactaataatgatcg | |
| | ggtccaacgcctctgacaggatgggaatgggcgtcacctacctagctcta | |
| | attgcaacatttaaaatccagccattcttggctttgggatttttcctaag | |
| | aaagctgacatctagagaaaatttattgttaggagttgggttggccatgg | |
| | caacaacgttacaactgccagaggacattgaacaaatggcaaatggagtc | |
| | gctctggggctcatggctcttaaactgataacacaatttgaaacatacca | |
| | attgtggacggcattagtctccttaacgtgttcaaacacaatttttacgt | |
| | tgactgttgcctggagaacagccactctgattttggccggagtttcgctt | |
| | ttaccagtgtgccagtcttcaagcatgaggaaaacagattggctcccaat | |
| | gacagtggcagctatgggagttccaccccttccacttttttatttttagct | |
| | tgaaagacacactcaaaaggagaagctggccactgaatgaaggggtgatg | |
| | gctgttgggcttgtgagcattctggccagttctctccttagaaatgatgt | |
| | gcccatggctggaccattagtggccgggggcttgctgatagcgtgctacg | |
| | tcataactggcacgtcagcggacctcactgtagaaaaagccccagatgta | |
| | acatgggaggaagaggctgagcagacaggagtgtcccacaacttaatgat | |
| | cacagttgatgatgatggaacaatgagaataaaagatgatgagactgaga | |
| | acatcctaacagtgcttttaaaaacagcattactaatagtatcaggcatt | |
| | tttccatactccatacccgcaacattgttggtctggcacacttggcaaaa | |
| | acaaacccaaagatccggcgttttatgggacgtacccagcccccccagaga | |
| | cacagaaagcagaactggaagaaggggtttataggatcaaacagcaagga | |
| | atttttgggaaaacccaagtaggggttggagtacagaaagaaggagtctt | |
| | ccacaccatgtggcacgtcacaagaggggcagtgttgacacataatggga | |
| | aaagactggaaccaaactgggctagtgtgaaaaaagatctgatttcatat | |
| | ggaggaggatggagactgagcgcacaatggcaaaaggggggaggaggtgca | |
| | ggttattgccgtagagccagggaagaacccaaagaactttcaaaccacgc | |
| | caggcactttccagactactacaggggaaataggagcaattgcactggat | |
| | ttcaagcctggaacttcaggatctcctatcataaatagagagggaaaggt | |
| | agtgggactgtatggcaatggagtggttacaaagaatggtggctatgtca | |
| | gcggaatagcgcaaacaaatgcagaaccagatggaccgacaccagagttg | |
| | gaagaagagatgttcaaaaagcgaaacctgaccataatggatcttcatcc | |
| | tgggtcaggaaagacacggaaataccttccagctattgtcagagaggcaa | |
| | tcaagagacgtttaagaaccttaattttggcaccgacaagggtggttgca | |
| | gctgagatggaagaagcattgaaagggctcccaataaggtaccaaacaac | |
| | agcaacaaaatctgaacacacaggaagagagattgttgatctaatgtgcc | |
| | acgcaacgttcacaatgcgtttgctgtcaccagttagggttccaaattac | |
| | aacttgataataatggatgaggcccatttcacagacccagccagtatagc | |
| | ggctagagggtacatatcaactcgtgttggaatgggagaggcagccgcaa | |
| | tcttcatgacagcaacaccccctggaacagctgatgcctttcctcagagc | |
| | aacgctccaattcaagatgaagaaagggacataccagaacgctcatggaa | |
| | ttcaggcaatgaatggattaccgacttcgctgggaaaacggtgtggtttg | |
| | tccctagcattaaagccggaaatgacatagcaaactgcttgcgaaaaaac | |
| | gggaaaaaagtcattcaacttagtaggaagacttttgacacagaatatca | |
| | gaagactaaactgaatgattgggactttgtggtgacaactgacatttcag | |
| | aaatgggggccaatttcaaagcagatagagtgatcgacccaagaagatgt | |
| | ctcaaaccagtgatcttgacagatggaccagagcgggtgatcctggccgg | |
| | accaatgccagtcaccgcggcgagtgctgcgcaaaggagagggagagttg | |
| | gcaggaacccacaaaaagagaatgaccagtacatattcacgggccagcct | |
| | ctcaacaatgatgaagaccatgctcactggacagaagcaaaaatgctgct | |
| | ggacaacatcaacacaccagaagggattataccagctctctttgaaccag | |
| | aaagggagaagtcagccgccatagacggtgagtatcgcctgaagggtgag | |
| | tccaggaagactttcgtggaactcatgaggagggtgaccttccagtttg | |
| | gttagcccataaagtagcatcagaaggaatcaaatacacagatagaaaat | |
| | ggtgctttgatgggcaacgcaataatcaaattttagaggagaacatggat | |
| | gtggaaatttggacaaaggaaggagaaaagaaaaaattgagacctaggtg | |
| | gcttgatgcccgcacttattcagatccattggcactcaaggaattcaagg | |
| | actttgcggctggcagaaagtcaatcgcccttgatcttgtgacagaaata | |
| | ggaagagtgccttcacatctagcccacagaacaagaaacgctctggacaa | |
| | tctggtgatgctgcatacgtcagaagatggcggtagggcttacaggcatg | |
| | cggtggaggaactaccagaaacaatggaaacactcctactcttgggacta | |
| | atgatcttgttgacaggtggagcaatgcttttcttgatatcaggtaaagg | |
| | gattggaaagacttcaataggactcatttgtgtaatcgcttccagcggca | |
| | tgttgtggatggccgaagttccactccaatggatcgcgtcggctatagtc | |
| | ctggagtttttatgatggtgttgctcataccagaaccagaaaagcagag | |
| | aacccccccaagacaaccaactcgcatatgtcgtgataggcatacttacat | |
| | tggctgcaacaatagcagccaatgaaatgggactgctggaaaccacaaag | |
| | agagacttaggaatgtctaaggagccaggtgttgtttctccaaccagcta | |
| | tttggatgtggacttgcacccagcatcagcctggacattgtacgccgtgg | |
| | ccactacagtaataacaccaatgttaagacataccatagagaattctaca | |
| | gcaaatgtgtccctggcagctatagccaaccaggcagtggtcctgatggg | |
| | tttggacaaaggatggccaatatcaaaaatggacttaggcgtgccactac | |
| | tggcactgggttgctattcacaagtgaacccactgactctaactgcggca | |
| | gtacttttgctaatcacacattatgctatcataggtccaggattgcaagc | |
| | aaaagccacccgtgaagctcagaaaggacagctgctggaataatgaaga | |

TABLE 13-continued

| DENV polynucleotide sequences and amino acid sequences | | |
|---|---|---|
| Name | Sequence | SEQ ID NO |
| | atccaacagtggatgggataatgacaatagacctagattctgtaatattt gattcaaaatttgaaaaacaactgggacaggttatgctcctggttttgtg cgcagtccaactcttgctaatgagaacatcatgggccttgtgtgaagctt taactctagctacaggaccaataacaacactctgggaaggatcacctggt aagttctggaacaccacgatagctgtttccatggcgaacatttttagagg gagctatttagcaggagctgggcttgctttttctattatgaaatcagttg gaacaggaaaaagaggaacaggctcacaaggtgaaactttaggagaaaaa tggaaaaagaaattaaatcaattatcccggaaagagtttgacctttacaa gaaatctggaatcactgaagtggatagaacagaagccaaagaagggttga aaagaggagagacaacacatcatgccgtgtcccgaggtagcgcaaaactt caatggtttgtggaaagaaacatggtcgttcccgaaggaagagtcataga cttgggctgtggaagaggaggctggtcatattactgtgcaggactgaaaa aagtcacagaagtgcgaggatacacaaaaggcggtccaggacacgaagaa ccagtacctatgtctacatatggatggaacatagttaagttaatgagcgg aaaggatgtgttctatctcccacctgaaaagtgtgataccctgttgtgtg acattggagaatcttcaccaagcccaacagtggaagagagcagaactata agagttttgaagatggttgaaccatggctaaaaaacaaccagttttgcat taaagttttgaacccttacatgccaactgtgattgagcacctagaaagac tacaaaggaaacatggaggaatgcttgtgagaaatccactttcacgaaac tccacgcacgaaatgtactggatatctaatggcacaggtaacattgtctc ttcagtcaacatggtgtctagattgctactgaacaggttcacgatgacac acaggagacccaccatagagaaagatgtggatttaggagcaggaactcga catgttaatgcggaaccagaaacacccaacatggatgtcattggggaaag aataaaaaggatcaaggaggagcataattcaacatggcactatgatgacg aaaacccctacaaaacgtgggcttaccatggatcctatgaagtcaaagcc acaggctcagcctcctccatgataaatggagtcgtgaaactcctcaccaa accatgggatgtggtgcccatggtgacacagatggcaatgacagacacaa ctccatttggccagcagagagtctttaaagagaaagtggacaccaggacg cccaggcccatgccagggacaagaaaggctatggagatcacagcggagtg gctctggagaaccctgggaaggaacaaaagacccagattatgcacaaggg aagagtttacaaaaaaggtcagaactaacgcagccatgggcgccgttttc acagaggagaaccaatgggacagtgcgaaagctgctgttgaggatgaaga attttggaaacttgtggacagagaacgtgaactccacaaattgggcaaat gtggaagctgcgtttataacatgatgggcaagagagagaaaaaacttgga gagtttggcaaagcaaaaggcagtagagctatatggtacatgtggttggg agccaggtaccttgagttcgaagcccttggattcttaaatgaagaccact ggttctcgcgtgaaaactcttacagtggagtagaaggagaaggactgcac aagctaggctacatattaagggacatttccaagatacccggaggagccat gtatgctgatgacacagctggttgggacacaagaataacagaagatgacc tgcacaatgaggaaaagatcatacagcaaatggaccctgaacacaggcag ttagcgaacgctatattcaagctcacataccaaaacaaagtggtcaaagt tcaacgaccgactccaacgggcacggtaatggatattatatctaggaaag accaaaggggcagtggacaactgggaacttatggcctgaatacattcacc aacatggaagcccagttagtcagacaaatggaaggagaaggtgtgctgac aaaggcagacctcgagaaccctcatctgctagagaagaaaatcacacaat ggttggaaaccaaaggagtggagaggttaaaaagaatggccattagcggg gatgattgcgtggtgaaaccaatcgatgacaggttcgctaatgccctgct tgctttgaacgatatgggaaaggttcggaaagacatacctcaatggcagc catcaaagggatggcatgattggcaacaggttcctttctgctcccaccac tttcatgaattgatcatgaaagatggaagaaagttggtggttccctgcag accccaggacgaactaataggaagagcaagaatctctcaaggagcgggat ggagccttagagaaactgcatgtctggggaaagcctacgcccaaatgtgg agtctcatgtattttcacagaagagatctcagattagcatccaacgccat atgttcagcagtaccagtccactgggttcccacaagtagaacgacatggt ctattcatgctcaccatcagtggatgactacagaagacatgcttactgtt tggaacagggtgtggatagaggaaaatccatggatggaagacaaaactcc agttacaacttgggaaaatgttccatatctaggaaagagagaagaccaat ggtgtggatcacttattggtctcacttccagagcaacctgggcccagaac atacccacagcaattcaacaggtgagaagccttataggcaatgaagagtt cctggactacatgccttcaatgaagagattcaggaaggaagaggagtcgg agggagccatttggtaaacgtaggaagtggaaaagaggctaactgtcagg ccaccttaagccacagtacggaagaagctgtgctgcctgtgagccccgtc caaggacgttaaaagaagaagtcaggccccaaagccacggtttgagcaaa ccgtgctgcctgtagctccgtcgtggggacgtaaaacctgggaggctgca aactgtggaagctgtacgcacggtgtagcagactagcggttagaggagac ccctcccatgacacaacgcagcagcggggcccgagcactgagggaagctg tacctccttgcaaaggactagaggttagaggagacccccccgcaaataaaa acagcatattgacgctgggagagaccagagatcctgctgtctcctcagca tcattccaggcacagaacgccagaaaatggaatggtgctgttgaatcaac aggttct | |
| DEN-4 (NC_002640.1) | MNQRKKVVRPPFNMLKRERNRVSTPQGLVKRFSTGLFSGKGPLRMVLAFI TFLRVLSIPPTAGILKRWGQLKKNKAIKILIGFRKEIGRMLNILNGRKRS TITLLCLIPTVMAFSLSTRDGEPLMIVAKHERGRPLLFKTTEGINKCTLI AMDLGEMCEDTVTYKCPLLVNTEPEDIDCWCNLTSTWVMYGTCTQSGERR | 21 |

TABLE 13-continued

DENV polynucleotide sequences and amino acid sequences

| Name | Sequence | SEQ ID NO |
|---|---|---|
| | REKRSVALTPHSGMGLETRAETWMSSEGAWKHAQRVESWILRNPGFALLA<br>GFMAYMIGQTGIQRTVFFVLMMLVAPSYGMRCVGVGNRDFVEGVSGGAWV<br>DLVLEHGGCVTTMAQGKPTLDFELTKTTAKEVALLRTYCIEASISNITTA<br>TRCPTQGEPYLKEEQDQQYICRRDVVDRGWGNGCGLFGKGGVVTCAKFSC<br>SGKITGNLVQIENLEYTVVVTVHNGDTHAVGNDTSNHGVTAMITPRSPSV<br>EVKLPDYGELTLDCEPRSGIDFNEMILMKMKKKTWLVHKQWFLDLPLPWT<br>AGADTSEVHWNYKERMVTFKVPHAKRQDVTVLGSQEGAMHSALAGATEVD<br>SGDGNHMFAGHLKCKVRMEKLRIKGMSYTMCSGKFSIDKEMAETQHGTTV<br>VKVKYEGAGAPCKVPIEIRDVNKEKVVGRIISSTPLAENTNSVTNIELEP<br>PFGDSYIVIGVGNSALTLHWFRKGSSIGKMFESTYRGAKRMAILGETAWD<br>FGSVGGLFTSLGKAVHQVFGSVYTTMFGGVSWMIRILIGFLVLWIGTNSR<br>NTSMAMTCIAVGGITLFLGFTVQADMGCVASWSGKELKCGSGIFVVDNVH<br>TWTEQYKFQPESPARLASAILNAHKDGVCGIRSTTRLENVMWKQITNELN<br>YVLWEGGHDLTVVAGDVKGVLTKGKRALTPPVSDLKYSWKTWGKAKIFTP<br>EARNSTFLIDGPDTSECPNERRAWNSLEVEDYGFGMFTTNIWMKFREGSS<br>EVCDHRLMSAAIKDQKAVHADMGYWIESSKNQTWQIEKASLIEVKTCLWP<br>KTHTLWSNGVLESQMLIPKSYAGPFSQHNYRQGYATQTVGPWHLGKLEID<br>FGECPGTTVTIQEDCDHRGPSLRTTTASGKLVTQWCCRSCTMPPLRFLGE<br>DGCWYGMEIRPLSEKEENMVKSQVTAGQGTSETFSMGLLCLTLFVEECLR<br>RRVTRKHMILVVVITLCAIILGGLTWMDLLRALIMLGDTMSGRIGGQIHL<br>AIMAVFKMSPGYVLGVFLRKLTSRETALMVIGMAMTTVLSIPHDLMELID<br>GISLGLILLKIVTQFDNTQVGTLALSLTFIRSTMPLVMAWRTIMAVLFVV<br>TLIPLCRTSCLQKQSHWVEITALILGAQALPVYLMTLMKGASRRSWPLNE<br>GIMAVGLVSLLGSALLKNDVPLAGPMVAGGLLLAAYVMSGSSADLSLEKA<br>ANVQWDEMADITGSSPIVEVKQDEDGSFSIRDVEETNMITLLVKLALITV<br>SGLYPLAIPVTMTLWYMWQVKTQRSGALWDVPSPAATKKAALSEGVYRIM<br>QRGLFGKTQVGVGIHMEGVFHTMWHVTRGSVICHETGRLEPSWADVRNDM<br>ISYGGGWRLGDKWDKEEDVQVLAIEPGKNPKHVQTKPGLFKTLTGEIGAV<br>TLDFKPGTSGSPIINRKGKVIGLYGNGVVTKSGDYVSAITQAERIGEPDY<br>EVDEDIFRKKRLTIMDLHPGAGKTKRILPSIVREALKRRLRTLILAPTRV<br>VAAEMEEALRGLPIRYQTPAVKSEHTGREIVDLMCHATFTTRLLSSTRVP<br>NYNLIVMDEAHFTDPSSVAARGYISTRVEMGEAAAIFMTATPPGATDPFP<br>QSNSPIEDIEREIPERSWNTGFDWITDYQGKTVWFVPSIKAGNDIANCLR<br>KSGKKVIQLSRKTFDTEYPKTKLTDWDFVVTTDISEMGANFRAGRVIDPR<br>RCLKPVILPDGPERVILAGPIPVTPASAAQRRGRIGRNPAQEDDQYVFSG<br>DPLKNDEDHAHWTEAKMLLDNIYTPEGIIPTLFGPEREKTQAIDGEFRLR<br>GEQRKTFVELMRRGDLPVWLSYKVASAGISYEDREWCFTGERNNQILEEN<br>MEVEIWTREGEKKKLRPRWLDARVYADPMALKDFKEFASGRKSITLDILT<br>EIASLPTYLSSRAKLALDNIVMLHTTERGGRAYQHALNELPESLETLMLV<br>ALLGAMTAGIFLFFMQGKGIGKLSMGLITIAVASGLLWVAEIQPQWIAAS<br>IILEFFLMVLLIPEPEKQRTPQDNQLIYVILTILTIIGLIAANEMGLIEK<br>TKTDFGFYQVKTETTILDVDLRPASAWTLYAVATTILTPMLRHTIENTSA<br>NLSLAAIANQAAVLMGLGKGWPLHRMDLGVPLLAMGCYSQVNPTTLTASL<br>VMLLVHYAIIGPGLQAKATREAQKRTAAGIMKNPTVDGITVIDLEPISYD<br>PKFEKQLGQVMLLVLCAGQLLLMRTTWAFCEVLTLATGPILTLWEGNPGR<br>FWNTTIAVSTANIFRGSYLAGAGLAFSLIKNAQTPRRGTGTTGETLGEKW<br>KRQLNSLDRKEFEEYKRSGILEVDRTEAKSALKDGSKIKHAVSRGSSKIR<br>WIVERGMVKPKGKVVDLGCGRGGWSYYMATLKNVTEVKGYTKGGPGHEEP<br>IPMATYGWNLVKLHSGVDVFYKPTEQVDTLLCDIGESSSNPTIEEGRTLR<br>VLKMVEPWLSSKPEFCIKVLNPYMPTVIEELEKLQRKHGGNLVRCPLSRN<br>STHEMYWVSGASGNIVSSVNTTSKMLLNRFTTRHRKPTYEKDVDLGAGTR<br>SVSTETEKPDMTIIGRRLQRLQEEHKETWHYDQENPYRTWAYHGSYEAPS<br>TGSASSMVNGVVKLLTKPWDVIPMVTQLAMTDTTPFGQQRVFKEKVDTRT<br>PQPKPGTRMVMTTTANWLWALLGKKKNPRLCTREEFISKVRSNAAIGAVF<br>QEEQGWTSASEAVNDSRFWELVDKERALHQEGKCESCVYNMMGKREKKLG<br>EFGRAKGSRAIWYMWLGARFLEFEALGFLNEDHWFGRENSWSGVEGEGLH<br>RLGYILEEIDKKDGDLMYADDTAGWDTRITEDDLQNEELITEQMAPHHKI<br>LAKAIFKLTYQNKVVKVLRPTPRGAVMDIISRKDQRGSGQVGTYGLNTFT<br>NMEVQLIRQMEAEGVITQDDMQNPKGLKERVEKWLKECGVDRLKRMAISG<br>DDCVVKPLDERFGTSLLFLNDMGKVRKDIPQWEPSKGWKNWQEVPFCSHH<br>FHKIFMKDGRSLVVPCRNQDELIGRARISQGAGW<br>SLRETACLGKAYAQMWSLMYFHRRDLRLASMAICSAVPTEWFPTSRTTWS<br>IHAHHQWMTTEDMLKVWNRVWIEDNPNMTDKTPVHSWEDIPYLGKREDLW<br>CGSLIGLSSRATWAKNIHTAITQVRNLIGKEEYVDYMPVMKRYSAPSESE<br>GVL | |
| DEN-4<br>(NC_002640.1) | agttgttagtctgtgtggaccgacaaggacagttccaaatcggaagcttg<br>cttaacacagttctaacagtttgtttgaatagagagcagatctctggaaa<br>aatgaaccaacgaaaaaaggtggttagaccacctttcaatatgctgaaac<br>gcgagagaaaccgcgtatcaacccctcaagggttggtgaagagattctca<br>accggactttttctgggaaaggacccttacggatggtgctagcattcat<br>cacgtttttgcgagtcctttccatcccaccaacagcagggattctgaaga<br>gatggggacagttgaagaaaaataaggccatcaagatactgattggattc<br>aggaaggagataggccgcatgctgaacatcttgaacgggagaaaaaggtc<br>aacgataacattgctgtgcttgattcccaccgtaatggcgttttccctca | 22 |

TABLE 13-continued

DENV polynucleotide sequences and amino acid sequences

| Name | Sequence | SEQ ID NO |
|---|---|---|
| | gcacaagagatggcgaacccctcatgatagtggcaaaacatgaaagggggg<br>agacctctcttgtttaagacaacagaggggatcaacaaatgcactctcat<br>tgccatggacttgggtgaaatgtgtgaggacactgtcacgtataaatgcc<br>ccctactggtcaataccgaacctgaagacattgattgctggtgcaacctc<br>acgtctacctgggtcatgtatgggacatgcacccagagcggagaacggag<br>acgagagaagcgctcagtagctttaacaccacattcaggaatgggattgg<br>aaacaagagctgagacatggatgtcatcggaaggggcttggaagcatgct<br>cagagagtagagagctggatactcagaaacccaggattcgcgctcttggc<br>aggatttatggcttatatgattgggcaaacaggaatccagcgaactgtct<br>tctttgtcctaatgatgctggtcgccccatcctacggaatgcgatgcgta<br>ggagtaggaaacagagactttgtggaaggagtctcaggtggagcatgggt<br>cgacctggtgctagaacatggaggatgcgtcacaaccatggcccagggaa<br>aaccaaccttggattttgaactgactaagacaacagccaaggaagtggct<br>ctgttaagaacctattgcattgaagcctcaatatcaaacataactacggc<br>aacaagatgtccaacgcaaggagagccttatctgaaagaggaacaggacc<br>aacagtacatttgccggagagatgtggtagacagagggtggggcaatggc<br>tgtggcttgtttggaaaaggaggagttgtgacatgtgcgaagttttcatg<br>ttcggggaagataacaggcaatttggtccaaattgagaaccttgaataca<br>cagtggttgtaacagtccacaatggagacacccatgcagtaggaaatgac<br>acatccaatcatggagttacagccatgataactcccaggtcaccatcggt<br>ggaagtcaaattgccggactatggagaactaacactcgattgtgaaccca<br>ggtctggaattgactttaatgagatgattctgatgaaaatgaaaaagaaa<br>acatggctcgtgcataagcaatggttttggatctgcctcttccatggac<br>agcaggagcagacacatcagaggttcactggaattacaaagagagaatgg<br>tgacatttaaggttcctcatgccaagagacaggatgtgacagtgctggga<br>tctcaggaaggagccatgcattctgccctcgctggagccacagaagtgga<br>ctccggtgatggaaatcacatgtttgcaggacatcttaagtgcaaagtcc<br>gtatggagaaattgagaatcaagggaatgtcatacacgatgtgttcagga<br>aagttttcaattgacaaagagatggcagaaacacagcatgggacaacagt<br>ggtgaaagtcaagtatgaaggtgctggagctccgtgtaaagtccccatag<br>agataagagatgtaaacaaggaaaaagtggttgggcgtatcatctcatcc<br>acccctttggctgagaataccaacagtgtaaccaacatagaattagaacc<br>cccctttggggacagctacatagtgataggtgttggaaacagcgcattaa<br>cactccattggttcaggaaagggagttccattggcaagatgtttgagtcc<br>acatacagaggtgcaaaacgaatggccattctaggtgaaacagcttggga<br>ttttggttccgttggtggactgttcacatcattgggaaaggctgtgcacc<br>aggtttttggaagtgtgtatacaaccatgtttggaggagtctcatggatg<br>attagaatcctaattgggttcttagtgttgtggattggcacgaactcgag<br>gaacacttcaatggctatgacgtgcatagctgttggaggaatcactctgt<br>ttctgggcttcacagttcaagcagacatgggttgtgtggcgtcatggagt<br>gggaaagaattgaagtgtggaagcggaatttttgtggttgacaacgtgca<br>cacttggacagaacagtacaaatttcaaccagagtccccagcgagactag<br>cgtctgcaatattaaatgcccacaaagatggggtctgtggaattagatca<br>accacgaggctggaaaatgtcatgtggaagcaaataaccaacgagctaaa<br>ctatgttctctgggaaggaggacatgacctcactgtagtggctggggatg<br>tgaagggggtgttgaccaaaggcaagagagcactcacacccccagtgagt<br>gatctgaaatattcatggaagacatggggaaaagcaaaaatcttcacccc<br>agaagcaagaaatagcacatttttaatagacggaccagacacctctgaat<br>gccccaatgaacgaagagcatggaactctcttgaggtggaagactatgga<br>tttggcatgttcacgaccaacatatggatgaaattccgagaaggaagttc<br>agaagtgtgtgaccacaggttaatgtcagctgcaattaaagatcagaaag<br>ctgtgcatgctgacatgggttattggatagagagctcaaaaaaccagacc<br>tggcagatagagaaagcatctcttattgaagtgaaaacatgtctgtggcc<br>caagacccacacactgtggagcaatggagtgctggaaagccagatgctca<br>ttccaaaatcatatgcgggcccttttttcacagcacaattaccgccagggc<br>tatgccacgcaaaccgtgggcccatggcacttaggcaaattagagataga<br>ctttggagaatgccccggaacaacagtcacaattcaggaggattgtgacc<br>atagaggcccatctttgaggaccaccactgcatctggaaaactagtcacg<br>caatggtgctgccgctcctgcacgatgcctcccttaaggttcttgggaga<br>agatgggtgctggtatgggatggagattaggcccttgagtgaaaaagaag<br>agaacatggtcaaatcacaggtgacggccggacagggcacatcagaaact<br>ttttctatgggtctgttgtgcctgaccttgtttgtggaagaatgcttgag<br>gagaagagtcactaggaaacacatgatattagttgtggtgatcactcttt<br>gtgctatcatcctgggaggcctcacatggatggacttactacgagccctc<br>atcatgttgggggacactatgtctggtagaataggaggacagatccacct<br>agccatcatggcagtgttcaagatgtcaccaggatacgtgctgggtgtgt<br>ttttaaggaaactcacttcaagagagacagcactaatggtaataggaatg<br>gccatgacaacggtgctttcaattccacatgaccttatggaactcattga<br>tggaatatcactgggactaattttgctaaaaatagtaacacagtttgaca<br>acacccaagtgggaaccttagctctttccttgactttcataagatcaaca<br>atgccattggtcatggcttggaggaccattatggctgtgttgtttgtggt<br>cacactcattcctttgtgcaggacaagctgtcttcaaaaacagtctcatt<br>gggtagaaataacagcactcatcctaggagcccaagctctgccagtgtac<br>ctaatgactcttatgaaaggagcctcaagaagatcttggcctcttaacga<br>gggcataatggctgtgggtttggttagtctcttaggaagcgctcttttaa | |

TABLE 13-continued

DENV polynucleotide sequences and amino acid sequences

| Name | Sequence | SEQ ID NO |
|---|---|---|
| | agaatgatgtccctttagctggcccaatggtggcaggaggcttacttctg<br>gcggcttacgtgatgagtggtagctcagcagatctgtcactagagaaggc<br>cgccaacgtgcagtgggatgaaatggcagacataacaggctcaagcccaa<br>tcgtagaagtgaagcaggatgaagatggctctttctccatacgggacgtc<br>gaggaaaccaatatgataaccctttggtgaaactggcactgataacagt<br>gtcaggtctctaccccttggcaattccagtcacaatgaccttatggtaca<br>tgtggcaagtgaaaacacaaagatcaggagccctgtgggacgtcccctca<br>cccgctgccactaaaaaagccgcactgtctgaaggagtgtacaggatcat<br>gcaaagagggttattcgggaaaactcaggttggagtagggatacacatgg<br>aaggtgtatttcacacaatgtggcatgtaacaagaggatcagtgatctgc<br>cacgagactgggagattggagccatcttgggctgacgtcaggaatgacat<br>gatatcatacggtgggggatggaggcttggagacaaatgggacaaagaag<br>aagacgttcaggtcctcgccatagaaccaggaaaaaatcctaaacatgtc<br>caaacgaaacctggccttttcaagaccctaactggagaaattggagcagt<br>aacattagatttcaaacccggaacgtctggttctcccatcatcaacagga<br>aaggaaaagtcatcggactctatggaaatggagtagttaccaaatcaggt<br>gattacgtcagtgccataacgcaagccgaaagaattggagagccagatta<br>tgaagtggatgaggacattttcgaaagaaaagattaactataatggact<br>tacaccccggagctggaaagacaaaaagaattcttccatcaatagtgaga<br>gaagccttaaaaaggaggctacgaactttgattttagctcccacgagagt<br>ggtggcggccgagatggaagaggccctacgtggactgccaatccgttatc<br>agaccccagctgtgaaatcagaacacacaggaagagagattgtagacctc<br>atgtgtcatgcaaccttcacaacaagacttttgtcatcaaccagggttcc<br>aaattacaaccttatagtgatggatgaagcacatttcaccgatccttcta<br>gtgtcgcggctagaggatacatctcgaccagggtggaaatgggagaggca<br>gcagccatcttcatgaccgcaacccctcccggagcgacagatccctttcc<br>ccagagcaacagcccaatagaagacatcgagagggaaattccggaaaggt<br>catggaacacagggttcgactggataacagactaccaagggaaaactgtg<br>tggtttgttcccagcataaaagctggaaatgacattgcaaattgtttgag<br>aaagtcgggaaagaaagttatccagttgagtaggaaaacctttgatacag<br>agtatccaaaaacgaaactcacggactgggactttgtggtcactacagac<br>atatctgaaatgggggccaattttagagccgggagagtgatagaccctag<br>aagatgcctcaagccagttatcctaccagatgggccagagagagtcattt<br>tagcaggtcctattccagtgactccagcaagcgctgctcagagaagaggg<br>cgaataggaaggaacccagcacaagaagacgaccaatacgttttctccgg<br>agacccactaaaaaatgatgaagatcatgcccactggacagaagcaaaga<br>tgctgcttgacaatatctacaccccagaagggatcattccaacattgttt<br>ggtccggaaagggaaaaaacccaagccattgatggagagtttcgcctcag<br>aggggaacaaaggaagacttttgtggaattaatgaggagaggagaccttc<br>cggtgtggctgagctataaggtagcttctgctggcatttcttacgaagat<br>cgggaatggtgcttcacaggggaaagaaataaccaaattttagaagaaaa<br>catggaggttgaaatttggactagagagggagaaaagaaaaagctaaggc<br>caagatggttagatgcacgtgtatacgctgaccccatggctttgaaggat<br>ttcaaggagtttgccagtggaaggaagagtataactctcgacatcctaac<br>agagattgccagtttgccaacttacctttcctctagggccaagctcgccc<br>ttgataacatagtcatgctccacacaacagaaagaggagggagggcctat<br>caacacgccctgaacgaacttccggagtcactggaaacactcatgcttgt<br>agctttactaggtgctatgacagcaggcatcttcctgtttttcatgcaag<br>ggaaaggaatagggaaattgtcaatgggtttgataaccattgcggtggct<br>agtggcttgctctgggtagcagaaattcaaccccagtggatagcggcctc<br>aatcatactagagtttttttctcatggtactgttgataccggaaccagaaa<br>aacaaaggaccccacaagacaatcaattgatctacgtcatattgaccatt<br>ctcaccatcattggtctaatagcagccaacgagatggggctgattgaaaa<br>aacaaaaacggattttgggttttaccaggtaaaaacagaaaccaccatcc<br>tcgatgtggacttgagaccagcttcagcatggacgctctatgcagtagcc<br>accacaattctgactcccatgctgagacacaccatagaaaacacgtcggc<br>caacctatctctagcagccattgccaaccaggcagccgtcctaatggggc<br>ttggaaaaggatggccgctccacagaatggacctcggtgtgccgctgtta<br>gcaatgggatgctattctcaagtgaacccaacaaccttgacagcatcctt<br>agtcatgcttttagtccattatgcaataataggcccaggattgcaggcaa<br>aagccacaagagaggcccagaaaaggacagctgctgggatcatgaaaaat<br>cccacagtggacgggataacagtaatagatctagaaccaatatcctatga<br>cccaaaatttgaaaagcaattagggcaggtcatgctactagtcttgtgtg<br>ctggacaactactcttgatgagaacaacatgggctttctgtgaagtcttg<br>actttggccacaggaccaatcttgaccttgtgggagggcaacccgggaag<br>gttttggaacacgaccatagccgtatccaccgccaacattttcaggggaa<br>gttacttggcgggagctggactggctttttcactcataaagaatgcacaa<br>acccctaggaggggaactgggaccacaggagagacactgggagagaagtg<br>gaagagacagctaaactcattagacagaaaagagtttgaagagtataaaa<br>gaagtggaatactagaagtggacaggactgaagccaagtctgccctgaaa<br>gatgggtctaaaatcaagcatgcagtatcaagagggtccagtaagatcag<br>atggattgttgagagagggatggtaaagccaaaagggaaagttgtagatc<br>ttggctgtgggagaggaggatggtcttattacatggcgacactcaagaac<br>gtgactgaagtgaaagggtatacaaaaggaggtccaggacatgaagaacc<br>gattcccatggctacttatggttggaatttggtcaaactccattcagggg | |

TABLE 13-continued

DENV polynucleotide sequences and amino acid sequences

| Name | Sequence | SEQ ID NO |
|---|---|---|
| | ttgacgtgttctacaaacccacagagcaagtggacaccctgctctgtgat<br>attggggagtcatcttctaatccaacaatagaggaaggaagaacattaag<br>agttttgaagatggtggagccatggctctcttcaaaacctgaattctgca<br>tcaaagtccttaacccctacatgccaacagtcatagaagagctggagaaa<br>ctgcagagaaaacatggtgggaaccttgtcagatgcccgctgtccaggaa<br>ctccacccatgagatgtattgggtgtcaggagcgtcgggaaacattgtga<br>gctctgtgaacacaacatcaaagatgttgttgaacaggttcacaacaagg<br>cataggaaacccacttatgagaaggacgtagatcttggggcaggaacgag<br>aagtgtctccactgaaacagaaaaaccagacatgacaatcattgggagaa<br>ggcttcagcgattgcaagaagagcacaaagaaacctggcattatgatcag<br>gaaaacccatacagaacctgggcgtatcatggaagctatgaagctccttc<br>gacaggctctgcatcctccatggtgaacggggtggtaaaactgctaacaa<br>aaccctgggatgtgattccaatggtgactcagttagccatgacagataca<br>acccctttgggcaacaaagagtgttcaaagagaaggtggataccagaac<br>accacaaccaaaacccggtacacgaatggttatgaccacgacagccaatt<br>ggctgtgggccctccttggaaagaagaaaaatcccagactgtgcacaagg<br>gaagagttcatctcaaaagttagatcaaacgcagccataggcgcagtctt<br>tcaggaagaacagggatggacatcagccagtgaagctgtgaatgacagcc<br>ggttttgggaactggttgacaaagaaagggccctacaccaggaagggaaa<br>tgtgaatcgtgtgtctataacatgatgggaaaacgtgagaaaaagttagg<br>agagtttggcagagccaagggaagccgagcaatctggtacatgtggctgg<br>gagcgcggtttctggaatttgaagccctgggtttttgaatgaagatcac<br>tggtttggcagagaaaattcatggagtggagtggaaggggaaggtctgca<br>cagattgggatatatcctggaggagatagacaagaaggatggagacctaa<br>tgtatgctgatgacacagcaggctgggacacaagaatcactgaggatgac<br>cttcaaaatgaggaactgatcacggaacagatggctccccaccacaagat<br>cctagccaaagccattttcaaactaacctatcaaaacaaagtggtgaaag<br>tcctcagacccacaccgcggggagcggtgatggatatcatatccaggaaa<br>gaccaaagaggtagtggacaagttggaacatatggtttgaacacattcac<br>caacatggaagttcaactcatccgccaaatggaagctgaaggagtcatca<br>cacaagatgacatgcagaacccaaaagggttgaaagaaagagttgagaaa<br>tggctgaaagagtgtggtgtcgacaggttaaagaggatggcaatcagtgg<br>agacgattgcgtggtgaagcccctagatgagaggtttggcacttccctcc<br>tcttcttgaacgacatgggaaaggtgaggaaagacattccgcagtgggaa<br>ccatctaagggatggaaaaactggcaagaggttcctttttgctcccacca<br>ctttcacaagatctttatgaaggatggccgctcactagttgttccatgta<br>gaaaccaggatgaactgatagggagagccagaatctcgcagggagctgga<br>tggagcttaagagaaacagcctgcctgggcaaagcttacgcccagatgtg<br>gtcgcttatgtacttccacagaagggatctgcgtttagcctccatggcca<br>tatgctcagcagttccaacggaatggtttccaacaagcagaacaacatgg<br>tcaatccacgctcatcaccagtggatgaccactgaagatatgctcaaagt<br>gtggaacagagtgtggatagaagacaaccctaatatgactgacaagactc<br>cagtccattcgtgggaagatataccttacctagggaaaagagaggatttg<br>tggtgtggatccctgattggactttcttccagagccacctgggcgaagaa<br>cattcatacggccataacccaggtcaggaacctgatcggaaaagaggaat<br>acgtggattacatgccagtaatgaaaagatacagtgctccttcagagagt<br>gaaggagttctgtaattaccaacaacaaacaccaaaggctattgaagtca<br>ggccacttgtgccacggtttgagcaaaccgtgctgcctgtagctccgcca<br>ataatgggaggcgtaataatccccagggaggccatgcgccacggaagctg<br>tacgcgtggcatattggactagcggttagaggagacccctcccatcactg<br>ataaaacgcagcaaaagggggcccgaagccaggaggaagctgtactcctg<br>gtggaaggactagaggttagaggagacccccccaacacaaaaacagcata<br>ttgacgctgggaaagaccagagatcctgctgtctctgcaacatcaatcca<br>ggcacagagcgccgcaagatggattggtgttgttgatccaacaggttct | |

Example 19: Dengue Virus RNA Vaccine Immunogenicity in Mice

This study provides a preliminary analysis of the immunogenicity of a nucleic acid mRNA vaccine using a dengue virus (DENV) serotype 2 antigen in BALB/c mice. The study utilizes 44 groups of 10 BALB/c female (5) and male (5) mice (440 total, 6-8 weeks of age at study initiation, see Table 10 for design summary). In this study, construct numbers used are referenced and found in Table 14.

TABLE 14

Dengue Antigen polynucleotides

| Construct Number | Gene ID | Description | ORF SEQ ID NO | mRNA SEQ ID NO | Protein SEQ ID NO | Construct |
|---|---|---|---|---|---|---|
| 1 | 131502 | Dengue 2, D2Y98P strain, PrME | 24 | 25 | 23 | DEN2_D2Y98P_PrME_Hs3 |

TABLE 14-continued

| Dengue Antigen polynucleotides | | | | | | |
|---|---|---|---|---|---|---|
| Construct Number | Gene ID | Description | ORF SEQ ID NO | mRNA SEQ ID NO | Protein SEQ ID NO | Construct |
| | | transmembrane antigen | | | | |
| 2 | 131503 | Dengue 2, D2Y98P strain, PrME secreted antigen | 27 | 28 | 26 | DEN2_D2Y98P_PrME80_Hs3 |
| 3 | 131507 | Dengue 2, D2Y98P strain, PrME secreted antigen with dendritic targeting ScFv against mouse DEC205 | 30 | 31 | 29 | DEN2_D2Y98P_PrME80_ScFv.aDEC205.FLAG_Hs3 |
| 4 | 120554 | Dengue strain 2 domain 3 ferritin | 33 | 34 | 32 | DEN2_DIII_Ferritin_Hs3 |

The sequences are shown below:

TABLE 15

| Name | Sequence | SEQ ID NO |
|---|---|---|
| | MDAMKRGLCCVLLLCGAVFVSPFHLTTRNGEPHMIVSRQEKGKSLLFKTE NGVNMCTLMAMDLGELCEDTITYNCPLLRQNEPEDIDCWCNSTSTWVTYG TCTATGEHRREKRSVALVPHVGMGLETRTETWMSSEGAWKHAQRIETWVL RHPGFTIMAAILAYTIGTTYFQRVLIFILLTAVAPSMTMRCIGISNRDFV EGVSGGSWVDIVLEHGSCVTTMAKNKPTLDFELIKTEAKHPATLRKYCIE AKLTNTTTASRCPTQGEPSLNEEQDKRFVCKHSMVDRGWGNGCGLFGKGG IVTCAMFTCKKNMEGKIVQPENLEYTIVITPHSGEEGNDTGKHGKEIKVT PQSSITEAELTGYGTVTMECSPRTGLDFNEMVLLQMENKAWLVHRQWFLD LPLPWLPGADTQGSNWIQKETLVTFKNPHAKKQDVVVLGSQEGAMHTALT GATEIQMSSGNLLFTGHLKCRLRMDKLQLKGMSYSMCTGKFKVVKEIAET QHGTIVIRVQYEGDGSPCKIPFEIMDLEKRHVLGRLITVNPIVTEKDSPV NIEAEPPFGDSYIIIGVEPGQLKLSWFKKGSSIGQMFETTMRGAKRMAIL GDTAWDFGSLGGVFTSIGKALHQVFGAIYGAAFSGVSWTMKILIGVVITW IGMNSRSTSLSVSLVLVGVVTLYLGVMVQA | 23 |
| | ATGGATGCTATGAAAAGAGGCCTGTGTTGTGTGTTGCTGTTGTGCGGAGC TGTGTTTGTGTCACCTTTCCACCTGACTACCCGCAATGGTGAGCCCCATA TGATTGTGTCGCGCCAGGAGAAGGGGAAGTCCCTCCTGTTCAAAACTGAA AACGGCGTGAACATGTGTACCCTGATGGCCATGGACCTTGGAGAACTGTG CGAGGACACCATCACCTACAATTGTCCGCTCCTGCGCCAAAACGAACCAG AAGATATCGACTGCTGGTGCAATTCCACTTCAACCTGGGTTACCTACGGA ACTTGCACCGCCACGGGAGAACACAGAAGAGAAAAGCGCTCGGTGGCGCT GGTGCCTCATGTCGGAATGGGACTGGAGACTCGGACGGAGACTTGGATGT CCTCGGAGGGAGCATGGAAACATGCCCAACGGATCGAAACTTGGGTGCTG AGGCACCCTGGATTCACCATCATGGCAGCGATCCTCGCCTACACTATAGG TACTACCTACTTTCAAAGGGTGCTGATCTTCATTCTCCTCACCGCAGTGG CCCCTTCAATGACCATGAGGTGCATTGGGATCTCGAACCGGGACTTCGTC GAAGGAGTGTCCGGAGGTAGCTGGGTCGACATCGTCCTGGAACACGGAAG CTGCGTGACTACTATGGCGAAGAACAAGCCAACCTTGGACTTCGAGCTTA TCAAGACCGAGGCGAAGCACCCGGCCACTCTGAGAAAGTACTGCATCGAG GCTAAGCTCACCAACACGACCACTGCCTCGCGATGCCCAACTCAGGGAGA ACCGTCACTGAACGAAGAACAGGATAAACGCTTTGTGTGCAAGCATAGCA TGGTGGATAGAGGCTGGGGAAACGGCTGTGGACTCTTCGGAAAGGGTGGA ATTGTGACGTGCGCAATGTTCACTTGCAAGAAGAATATGGAAGGGAAGAT CGTCCAGCCGGAGAACCTGGAATACACTATCGTGATCACCCCGCACTCAG GCGAGGAGAACGCAGTGGGCAACGATACCGGGAAGCACGGGAAGGAAATC AAGGTGACCCCGCAGTCGTCCATTACCGAGGCCGAACTCACCGGATACGG CACTGTGACTATGGAATGCTCGCCACGGACCGGGCTGGATTTCAATGAGA TGGTGCTCTTGCAAATGGAGAACAAAGCCTGGCTGGTCCACCGCCAGTGG TTCCTCGACCTCCCCCTTCCGTGGCTGCCGGGAGCTGACACCCAAGGATC CAACTGGATCCAAAAAGAAACCCTTGTCACGTTTAAGAATCCACATGCCA AAAAGCAGGACGTGGTCGTGCTCGGAAGCCAGGAAGGAGCCATGCACACT GCGCTGACTGGAGCAACCGAAATTCAAATGTCGAGCGGCAACCTCCTCTT CACTGGACATCTGAAGTGCCGGCTGCGCATGGACAAACTGCAACTTAAGG GCATGTCATACTCGATGTGTACCGGCAAATTCAAGGTGGTGAAGGAGATC GCGGAGACTCAGCACGGGACCATCGTCATCCGGGTCCAGTATGAGGGTGA TGGTTCCCCCTGCAAGATCCCTTTCGAAATCATGGATCTGGAGAAACGTC | 24 |

TABLE 15-continued

| Name | Sequence | SEQ ID NO |
|---|---|---|
| | ACGTGCTGGGCCGGCTGATCACTGTGAATCCGATCGTTACGGAGAAAGAC<br>AGCCCGGTGAACATCGAAGCTGAACCGCCGTTTGGGGATAGCTACATTAT<br>CATCGGCGTGGAACCAGGCCAGCTCAAGTTGTCGTGGTTCAAGAAAGGAT<br>CCAGCATCGGACAGATGTTCGAAACCACTATGCGCGGAGCCAAACGCATG<br>GCTATCCTGGGGGACACGGCCTGGGACTTCGGGTCGCTGGGTGGTGTGTT<br>CACCTCCATTGGAAAGGCGCTCCATCAGGTGTTTGGTGCGATCTACGGCG<br>CCGCATTCTCCGGAGTGTCATGGACCATGAAGATCCTCATCGGAGTCGTC<br>ATCACCTGGATCGGCATGAATTCTCGGTCCACTTCCTTGAGCGTCAGCCT<br>GGTGCTGGTCGGAGTTGTGACTCTGTACCTTGGAGTGATGGTCCAGGCC | |
| | GGGAAAUAAGAGAGAAAAGAAGAGUAAGAAGAAAUAUAAGAGCCACCAUG<br>GAUGCUAUGAAAAGAGGCCUGUGUUGUGUGUUGCUGUUGUGCGGAGCUGU<br>GUUUGUGUCACCUUUCCACCUGACUACCCGCAAUGGUGAGCCCCAUAUGA<br>UUGUGUCGCGCCAGGAGAAGGGGAAGUCCCUCCUGUUCAAAACUGAAAAC<br>GGCGUGAACAUGUGUACCCUGAUGGCCAUGGACCUUGGAGAACUGUGCGA<br>GGACACCAUCACCUACAAUUGUCCGCUCCUGCGCCAAAACGAACCAGAAG<br>AUAUCGACUGCUGGUGCAAUUCCACUUCAACCUGGGUUACCUACGGAACU<br>UGCACCGCCACGGGAGAACACAGAAGAGAAAAGCGCUCGGUGGCGCUGGU<br>GCCUCAUGUCGGAAUGGGACUGGAGACUCGGACGGAGACUUGGAUGUCCU<br>CGGAGGGAGCAUGGAAACAUGCCCAACGGAUCGAAACUUGGGUGCUGAGG<br>CACCCUGGAUUCACCAUCAUGGCAGCGAUCCUCGCCUACACUAUAGGUAC<br>UACCUACUUUCAAAGGGUGCUGAUCUUCAUUCUCCUCACCGCAGUGGCCC<br>CUUCAAUGACCAUGAGGUGCAUUGGGAUCUCGAACCGGGACUUCGUCGAA<br>GGAGUGUCCGGAGGUAGCUGGGUCGACAUCGUCCUGGAACACGGAAGCUG<br>CGUGACUACUAUGGCGAAGAACAAGCCAACCUUGGACUUCGAGCUUAUCA<br>AGACCGAGGCGAAGCACCCGGCCACUCUGAGAAAGUACUGCAUCGAGGCU<br>AAGCUCACCAACACGACCACUGCCUCGCGAUGCCCAACUCAGGGAGAACC<br>GUCACUGAACGAAGAACAGGAUAAACGCUUUGUGUGCAAGCAUAGCAUGG<br>UGGAUAGAGGCUGGGGAAACGGCUGUGGACUCUUCGGAAAGGGUGGAAUU<br>GUGACGUGCGCAAUGUUCACUUGCAAGAAGAAUAUGGAAGGGAAGAUCGU<br>CCAGCCGGAGAACCUGGAAUACACUAUCGUGAUCACCCCGCACUCAGGCG<br>AGGAGAACGCAGUGGGCAACGAUACCGGGAAGCACGGGAAGGAAAUCAAG<br>GUGACCCCGCAGUCGUCCAUUACCGAGGCCGAACUCACCGGAUACGGCAC<br>UGUGACUAUGGAAUGCUCGCCACGGACCGGGCUGGAUUUCAAUGAGAUGG<br>UGCUCUUGCAAAUGGAGAACAAAGCCUGGCUGGUCCACCGCCAGUGGUUC<br>CUCGACCUCCCCCUUCCGUGGCUGCCGGGAGCUGACACCCAAGGAUCCAA<br>CUGGAUCCAAAAAGAAACCCUUGUCACGUUUAAGAAUCCACAUGCCAAAA<br>AGCAGGACGUGGUCGUGCUCGGAAGCCAGGAAGGAGCCAUGCACACUGCG<br>CUGACUGGAGCAACCGAAAUUCAAAUGUCGAGCGGCAACCUCCUCUUCAC<br>UGGACAUCUGAAGUGCCGGCUGCGCAUGGACAAACUGCAACUUAAGGGCA<br>UGUCAUACUCGAUGUGUACCGGCAAAUUCAAGGUGGUGAAGGAGAUCGCG<br>GAGACUCAGCACGGGACCAUCGUCAUCCGGGUCCAGUAUGAGGGUGAUGG<br>UUCCCCCUGCAAGAUCCCUUUCGAAAUCAUGGAUCUGGAGAAACGUCACG<br>UGCUGGGCCGGCUGAUCACUGUGAAUCCGAUCGUUACGGAGAAAGACAGC<br>CCGGUGAACAUCGAAGCUGAACCGCCGUUUGGGGAUAGCUACAUUAUCAU<br>CGGCGUGGAACCAGGCCAGCUCAAGUUGUCGUGGUUCAAGAAAGGAUCCA<br>GCAUCGGACAGAUGUUCGAAACCACUAUGCGCGGAGCCAAACGCAUGGCU<br>AUCCUGGGGGACACGGCCUGGGACUUCGGGUCGCUGGGUGGUGUGUUCAC<br>CUCCAUUGGAAAGGCGCUCCAUCAGGUGUUUGGUGCGAUCUACGGCGCCG<br>CAUUCUCCGGAGUGUCAUGGACCAUGAAGAUCCUCAUCGGAGUCGUCAUC<br>ACCUGGAUCGGCAUGAAUUCUCGGUCCACUUCCUUGAGCGUCAGCCUGGU<br>GCUGGUCGGAGUUGUGACUCUGUACCUUGGAGUGAUGGUCCAGGCCUGAU<br>AAUAGGCUGGAGCCUCGGUGGCCAUGCUUCUUGCCCCUUGGGCCUCCCCC<br>CAGCCCCUCCUCCCCUUCCUGCACCCGUACCCCCGUGGUCUUUGAAUAAA<br>GUCUGAGUGGGCGGC | 25 |
| | MDAMKRGLCCVLLLCGAVFVSPFHLTTRNGEPHMIVSRQEKGKSLLFKTE<br>NGVNMCTLMAMDLGELCEDTITYNCPLLRQNEPEDIDCWCNSTSTWVTYG<br>TCTATGEHRREKRSVALVPHVGMGLETRTETWMSSEGAWKHAQRIETWVL<br>RHPGFTIMAAILAYTIGTTYFQRVLIFILLTAVAPSMTMRCIGISNRDFV<br>EGVSGGSWVDIVLEHGSCVTTMAKNKPTLDFELIKTEAKHPATLRKYCIE<br>AKLTNTTTASRCPTQGEPSLNEEQDKRFVCKHSMVDRGWGNGCGLFGKGG<br>IVTCAMFTCKKNMEGKIVQPENLEYTIVITPHSGEEGNDTGKHGKEIKVT<br>PQSSITEAELTGYGTVTMECSPRTGLDFNEMVLLQMENKAWLVHRQWFLD<br>LPLPWLPGADTQGSNWIQKETLVTFKNPHAKKQDVVVLGSQEGAMHTALT<br>GATEIQMSSGNLLFTGHLKCRLRMDKLQLKGMSYSMCTGKFKVVKEIAET<br>QHGTIVIRVQYEGDGSPCKIPFEIMDLEKRHVLGRLITVNPIVTEKDSPV<br>NIEAEPPFGDSYIIIGVEPGQLKLSWFKKG | 26 |
| | ATGGATGCTATGAAAAGAGGCCTGTGTTGTGTGTTGCTGTTGTGCGGAGC<br>TGTGTTTGTGTCACCTTTCCACCTGACTACCCGCAATGGTGAGCCCCATA<br>TGATTGTGTCGCGCCAGGAGAAGGGGAAGTCCCTCCTGTTCAAAACTGAA<br>AACGGCGTGAACATGTGTACCCTGATGGCCATGGACCTTGGAGAACTGTG<br>CGAGGACACCATCACCTACAATTGTCCGCTCCTGCGCCAAAACGAACCAG<br>AAGATATCGACTGCTGGTGCAATTCCACTTCAACCTGGGTTACCTACGGA<br>ACTTGCACCGCCACGGGAGAACACAGAAGAGAAAAGCGCTCGGTGGCGCT<br>GGTGCCTCATGTCGGAATGGGACTGGAGACTCGGACGGAGACTTGGATGT | 27 |

TABLE 15-continued

| Name | Sequence | SEQ ID NO |
|---|---|---|
| | CCTCGGAGGGAGCATGGAAACATGCCCAACGGATCGAAACTTGGGTGCTG<br>AGGCACCCTGGATTCACCATCATGGCAGCGATCCTCGCCTACACTATAGG<br>TACTACCTACTTTCAAAGGGTGCTGATCTTCATTCTCCTCACCGCAGTGG<br>CCCCTTCAATGACCATGAGGTGCATTGGGATCTCGAACCGGGACTTCGTC<br>GAAGGAGTGTCCGGAGGTAGCTGGGTCGACATCGTCCTGGAACACGGAAG<br>CTGCGTGACTACTATGGCGAAGAACAAGCCAACCTTGGACTTCGAGCTTA<br>TCAAGACCGAGGCGAAGCACCCGGCCACTCTGAGAAAGTACTGCATCGAG<br>GCTAAGCTCACCAACACGACCACTGCCTCGCGATGCCCAACTCAGGGAGA<br>ACCGTCACTGAACGAAGAACAGGATAAACGCTTTGTGTGCAAGCATAGCA<br>TGGTGGATAGAGGCTGGGGAAACGGCTGTGGACTCTTCGGAAAGGGTGGA<br>ATTGTGACGTGCGCAATGTTCACTTGCAAGAAGAATATGGAAGGGAAGAT<br>CGTCCAGCCGGAGAACCTGGAATACACTATCGTGATCACCCCGCACTCAG<br>GCGAGGAGAACGCAGTGGGCAACGATACCGGGAAGCACGGGAAGGAAATC<br>AAGGTGACCCCGCAGTCGTCCATTACCGAGGCCGAACTCACCGGATACGG<br>CACTGTGACTATGGAATGCTCGCCACGGACCGGGCTGGATTTCAATGAGA<br>TGGTGCTCTTGCAAATGGAGAACAAAGCCTGGCTGGTCCACCGCCAGTGG<br>TTCCTCGACCTCCCCCTTCCGTGGCTGCCGGGAGCTGACACCCAAGGATC<br>CAACTGGATCCAAAAAGAAACCCTTGTCACGTTTAAGAATCCACATGCCA<br>AAAAGCAGGACGTGGTCGTGCTCGGAAGCCAGGAAGGAGCCATGCACACT<br>GCGCTGACTGGAGCAACCGAAATTCAAATGTCGAGCGGCAACCTCCTCTT<br>CACTGGACATCTGAAGTGCCGGCTGCGCATGGACAAACTGCAACTTAAGG<br>GCATGTCATACTCGATGTGTACCGGCAAATTCAAGGTGGTGAAGGAGATC<br>GCGGAGACTCAGCACGGGACCATCGTCATCCGGGTCCAGTATGAGGGTGA<br>TGGTTCCCCCTGCAAGATCCCTTTCGAAATCATGGATCTGGAGAAACGTC<br>ACGTGCTGGGCCGGCTGATCACTGTGAATCCGATCGTTACGGAGAAAGAC<br>AGCCCGGTGAACATCGAAGCTGAACCGCCGTTTGGGGATAGCTACATTAT<br>CATCGGCGTGGAACCAGGCCAGCTCAAGTTGTCGTGGTTCAAGAAAGGA | |
| | GGGAAAUAAGAGAGAAAAGAAGAGUAAGAAGAAAUAUAAGAGCCACCAUG<br>GAUGCUAUGAAAAGAGGCCUGUGUUGUGUGUUGCUGUUGUGCGGAGCUGU<br>GUUUGUGUCACCUUUCCACCUGACUACCCGCAAUGGUGAGCCCCAUAUGA<br>UUGUGUCGCGCCAGGAGAAGGGGAAGUCCCUCCUGUUCAAAACUGAAAAC<br>GGCGUGAACAUGUGUACCCUGAUGGCCAUGGACCUUGGAGAACUGUGCGA<br>GGACACCAUCACCUACAAUUGUCCGCUCCUGCGCCAAAACGAACCAGAAG<br>AUAUCGACUGCUGGUGCAAUUCCACUUCAACCUGGGUUACCUACGGAACU<br>UGCACCGCCACGGGAGAACACAGAAGAGAAAAGCGCUCGGUGGCGCUGGU<br>GCCUCAUGUCGGAAUGGGACUGGAGACUCGGACGGAGACUUGGAUGUCCU<br>CGGAGGGAGCAUGGAAACAUGCCCAACGGAUCGAAACUUGGGUGCUGAGG<br>CACCCUGGAUUCACCAUCAUGGCAGCGAUCCUCGCCUACACUAUAGGUAC<br>UACCUACUUUCAAAGGGUGCUGAUCUUCAUUCUCCUCACCGCAGUGGCCC<br>CUUCAAUGACCAUGAGGUGCAUUGGGAUCUCGAACCGGGACUUCGUCGAA<br>GGAGUGUCCGGAGGUAGCUGGGUCGACAUCGUCCUGGAACACGGAAGCUG<br>CGUGACUACUAUGGCGAAGAACAAGCCAACCUUGGACUUCGAGCUUAUCA<br>AGACCGAGGCGAAGCACCCGGCCACUCUGAGAAAGUACUGCAUCGAGGCU<br>AAGCUCACCAACACGACCACUGCCUCGCGAUGCCCAACUCAGGGAGAACC<br>GUCACUGAACGAAGAACAGGAUAAACGCUUUGUGUGCAAGCAUAGCAUGG<br>UGGAUAGAGGCUGGGGAAACGGCUGUGGACUCUUCGGAAAGGGUGGAAUU<br>GUGACGUGCGCAAUGUUCACUUGCAAGAAGAAUAUGGAAGGGAAGAUCGU<br>CCAGCCGGAGAACCUGGAAUACACUAUCGUGAUCACCCCGCACUCAGGCG<br>AGGAGAACGCAGUGGGCAACGAUACCGGGAAGCACGGGAAGGAAAUCAAG<br>GUGACCCCGCAGUCGUCCAUUACCGAGGCCGAACUCACCGGAUACGGCAC<br>UGUGACUAUGGAAUGCUCGCCACGGACCGGGCUGGAUUUCAAUGAGAUGG<br>UGCUCUUGCAAAUGGAGAACAAAGCCUGGCUGGUCCACCGCCAGUGGUUC<br>CUCGACCUCCCCCUUCCGUGGCUGCCGGGAGCUGACACCCAAGGAUCCAA<br>CUGGAUCCAAAAAGAAACCCUUGUCACGUUUAAGAAUCCACAUGCCAAAA<br>AGCAGGACGUGGUCGUGCUCGGAAGCCAGGAAGGAGCCAUGCACACUGCG<br>CUGACUGGAGCAACCGAAAUUCAAAUGUCGAGCGGCAACCUCCUCUUCAC<br>UGGACAUCUGAAGUGCCGGCUGCGCAUGGACAAACUGCAACUUAAGGGCA<br>UGUCAUACUCGAUGUGUACCGGCAAAUUCAAGGUGGUGAAGGAGAUCGCG<br>GAGACUCAGCACGGGACCAUCGUCAUCCGGGUCCAGUAUGAGGGUGAUGG<br>UUCCCCCUGCAAGAUCCCUUUCGAAAUCAUGGAUCUGGAGAAACGUCACG<br>UGCUGGGCCGGCUGAUCACUGUGAAUCCGAUCGUUACGGAGAAAGACAGC<br>CCGGUGAACAUCGAAGCUGAACCGCCGUUUGGGGAUAGCUACAUUAUCAU<br>CGGCGUGGAACCAGGCCAGCUCAAGUUGUCGUGGUUCAAGAAAGGAUGAU<br>AAUAGGCUGGAGCCUCGGUGGCCAUGCUUCUUGCCCCUUGGGCCUCCCCC<br>CAGCCCCUCCUCCCCUUCCUGCACCCGUACCCCCGUGGUCUUUGAAUAAA<br>GUCUGAGUGGGCGGC | 28 |
| | MDAMKRGLCCVLLLCGAVFVSPFHLTTRNGEPHMIVSRQEKGKSLLFKTE<br>NGVNMCTLMAMDLGELCEDTITYNCPLLRQNEPEDIDCWCNSTSTWVTYG<br>TCTATGEHRREKRSVALVPHVGMGLETRTETWMSSEGAWKHAQRIETWVL<br>RHPGFTIMAAILAYTIGTTYFQRVLIFILLTAVAPSMTMRCIGISNRDFV<br>EGVSGGSWVDIVLEHGSCVTTMAKNKPTLDFELIKTEAKHPATLRKYCIE<br>AKLTNTTTASRCPTQGEPSLNEEQDKRFVCKHSMVDRGWGNGCGLFGKGG<br>IVTCAMFTCKKNMEGKIVQPENLEYTIVITPHSGEEGNDTGKHGKEIKVT<br>PQSSITEAELTGYGTVTMECSPRTGLDFNEMVLLQMENKAWLVHRQWFLD<br>LPLPWLPGADTQGSNWIQKETLVTFKNPHAKKQDVVVLGSQEGAMHTALT | 29 |

TABLE 15-continued

| Name | Sequence | SEQ ID NO |
|---|---|---|
| | GATEIQMSSGNLLFTGHLKCRLRMDKLQLKGMSYSMCTGKFKVVKEIAET<br>QHGTIVIRVQYEGDGSPCKIPFEIMDLEKRHVLGRLITVNPIVTEKDSPV<br>NIEAEPPFGDSYIIIGVEPGQLKLSWFKKGGGGGSGGGGSGGGGSEVKLQ<br>QSGTEVVKPGASVKLSCKASGYIFTSYDIDWVRQTPEQGLEWIGWIFPGE<br>GSTEYNEKFKGRATLSVDKSSSTAYMELTRLTSEDSAVYFCARGDYYRRY<br>FDLWGQGTTVTVSSGGGGSGGGGSGGGGSDIQMTQSPSFLSTSLGNSITI<br>TCHASQNIKGWLAWYQQKSGNAPQLLIYKASSLQSGVPSRFSGSGSGTDY<br>IFTISNLQPEDIATYYCQHYQSFPWTFGGGTKLEIKRDYKDDDDK | |
| | ATGGATGCTATGAAAAGAGGCCTGTGTTGTGTGTTGCTGTTGTGCGGAGC<br>TGTGTTTGTGTCACCTTTCCACCTGACTACCCGCAATGGTGAGCCCCATA<br>TGATTGTGTCGCGCCAGGAGAAGGGGAAGTCCCTCCTGTTCAAAACTGAA<br>AACGGCGTGAACATGTGTACCCTGATGGCCATGGACCTTGGAGAACTGTG<br>CGAGGACACCATCACCTACAATTGTCCGCTCCTGCGCCAAAACGAACCAG<br>AAGATATCGACTGCTGGTGCAATTCCACTTCAACCTGGGTTACCTACGGA<br>ACTTGCACCGCCACGGGAGAACACAGAAGAGAAAAGCGCTCGGTGGCGCT<br>GGTGCCTCATGTCGGAATGGGACTGGAGACTCGGACGGAGACTTGGATGT<br>CCTCGGAGGGAGCATGGAAACATGCCCAACGGATCGAAACTTGGGTGCTG<br>AGGCACCCTGGATTCACCATCATGGCAGCGATCCTCGCCTACACTATAGG<br>TACTACCTACTTTCAAAGGGTGCTGATCTTCATTCTCCTCACCGCAGTGG<br>CCCCTTCAATGACCATGAGGTGCATTGGGATCTCGAACCGGGACTTCGTC<br>GAAGGAGTGTCCGGAGGTAGCTGGGTCGACATCGTCCTGGAACACGGAAG<br>CTGCGTGACTACTATGGCGAAGAACAAGCCAACCTTGGACTTCGAGCTTA<br>TCAAGACCGAGGCGAAGCACCCGGCCACTCTGAGAAAGTACTGCATCGAG<br>GCTAAGCTCACCAACACGACCACTGCCTCGCGATGCCCAACTCAGGGAGA<br>ACCGTCACTGAACGAAGAACAGGATAAACGCTTTGTGTGCAAGCATAGCA<br>TGGTGGATAGAGGCTGGGGAAACGGCTGTGGACTCTTCGGAAAGGGTGGA<br>ATTGTGACGTGCGCAATGTTCACTTGCAAGAAGAATATGGAAGGGAAGAT<br>CGTCCAGCCGGAGAACCTGGAATACACTATCGTGATCACCCCGCACTCAG<br>GCGAGGAGAACGCAGTGGGCAACGATACCGGGAAGCACGGGAAGGAAATC<br>AAGGTGACCCCGCAGTCGTCCATTACCGAGGCCGAACTCACCGGATACGG<br>CACTGTGACTATGGAATGCTCGCCACGGACCGGGCTGGATTTCAATGAGA<br>TGGTGCTCTTGCAAATGGAGAACAAAGCCTGGCTGGTCCACCGCCAGTGG<br>TTCCTCGACCTCCCCCTTCCGTGGCTGCCGGGAGCTGACACCCAAGGATC<br>CAACTGGATCCAAAAAGAAACCCTTGTCACGTTTAAGAATCCACATGCCA<br>AAAAGCAGGACGTGGTCGTGCTCGGAAGCCAGGAAGGAGCCATGCACACT<br>GCGCTGACTGGAGCAACCGAAATTCAAATGTCGAGCGGCAACCTCCTCTT<br>CACTGGACATCTGAAGTGCCGGCTGCGCATGGACAAACTGCAACTTAAGG<br>GCATGTCATACTCGATGTGTACCGGCAAATTCAAGGTGGTGAAGGAGATC<br>GCGGAGACTCAGCACGGGACCATCGTCATCCGGGTCCAGTATGAGGGTGA<br>TGGTTCCCCCTGCAAGATCCCTTTCGAAATCATGGATCTGGAGAAACGTC<br>ACGTGCTGGGCCGGCTGATCACTGTGAATCCGATCGTTACGGAGAAAGAC<br>AGCCCGGTGAACATCGAAGCTGAACCGCCGTTTGGGGATAGCTACATTAT<br>CATCGGCGTGGAACCAGGCCAGCTCAAGTTGTCGTGGTTCAAGAAAGGAG<br>GAGGTGGAGGATCCGGAGGCGGAGGGTCGGGCGGTGGTGGATCGGAGGTC<br>AAACTGCAGCAATCAGGGACCGAAGTCGTGAAGCCGGGGGCTTCAGTCAA<br>GCTGTCCTGCAAGGCCAGCGGCTATATCTTCACTAGCTACGACATCGATT<br>GGGTGCGGCAGACTCCGGAGCAAGGACTCGAGTGGATTGGGTGGATCTTT<br>CCGGGCGAGGGATCAACCGAGTACAACGAAAAATTTAAGGGACGGGCAAC<br>GCTGTCCGTGGACAAGAGCTCATCTACGGCGTACATGGAGCTGACGCGGC<br>TCACGTCAGAGGATTCCGCCGTCTACTTCTGTGCCAGGGGCGACTACTAC<br>CGGCGCTACTTTGATCTGTGGGGACAAGGAACGACCGTGACTGTCTCATC<br>AGGCGGCGGCGGATCGGGAGGAGGCGGATCGGGTGGCGGTGGTTCGGACA<br>TTCAGATGACTCAATCGCCCAGCTTCCTGTCGACCTCACTGGGGAATTCT<br>ATTACGATCACTTGTCACGCTTCGCAGAACATCAAGGGTTGGCTGGCTTG<br>GTACCAGCAGAAAAGCGGTAACGCCCCGCAACTGCTCATCTACAAGGCAT<br>CGTCCCTGCAATCGGGAGTGCCGTCACGCTTTTCAGGATCGGGCTCCGGA<br>ACCGATTACATCTTTACCATCAGCAACCTGCAGCCGGAAGACATCGCCAC<br>TTACTACTGTCAACACTATCAGAGCTTTCCGTGGACCTTTGGAGGGGGGA<br>CCAAATTGGAGATCAAGCGCGACTACAAGGATGACGATGACAAA | 30 |
| | GGGAAAUAAGAGAGAAAAGAAGAGUAAGAAGAAAUAUAAGAGCCACCAUG<br>GAUGCUAUGAAAAGAGGCCUGUGUUGUGUGUUGCUGUUGUGCGGAGCUGU<br>GUUUGUGUCACCUUUCCACCUGACUACCCGCAAUGGUGAGCCCCAUAUGA<br>UUGUGUCGCGCCAGGAGAAGGGGAAGUCCCUCCUGUUCAAAACUGAAAAC<br>GGCGUGAACAUGUGUACCCUGAUGGCCAUGGACCUUGGAGAACUGUGCGA<br>GGACACCAUCACCUACAAUUGUCCGCUCCUGCGCCAAAACGAACCAGAAG<br>AUAUCGACUGCUGGUGCAAUUCCACUUCAACCUGGGUUACCUACGGAACU<br>UGCACCGCCACGGGAGAACACAGAAGAGAAAAGCGCUCGGUGGCGCUGGU<br>GCCUCAUGUCGGAAUGGGACUGGAGACUCGGACGGAGACUUGGAUGUCCU<br>CGGAGGGAGCAUGGAAACAUGCCCAACGGAUCGAAACUUGGGUGCUGAGG<br>CACCCUGGAUUCACCAUCAUGGCAGCGAUCCUCGCCUACACUAUAGGUAC<br>UACCUACUUUCAAAGGGUGCUGAUCUUCAUUCUCCUCACCGCAGUGGCCC<br>CUUCAAUGACCAUGAGGUGCAUUGGGAUCUCGAACCGGGACUUCGUCGAA<br>GGAGUGUCCGGAGGUAGCUGGGUCGACAUCGUCCUGGAACACGGAAGCUG<br>CGUGACUACUAUGGCGAAGAACAAGCCAACCUUGGACUUCGAGCUUAUCA<br>AGACCGAGGCGAAGCACCCGGCCACUCUGAGAAAGUACUGCAUCGAGGCU | 31 |

TABLE 15-continued

| Name | Sequence | SEQ ID NO |
|---|---|---|
| | AAGCUCACCAACACGACCACUGCCUCGCGAUGCCCAACUCAGGGAGAACC<br>GUCACUGAACGAAGAACAGGAUAAACGCUUUGUGUGCAAGCAUAGCAUGG<br>UGGAUAGAGGCUGGGGAAACGGCUGUGGACUCUUCGGAAAGGGUGGAAUU<br>GUGACGUGCGCAAUGUUCACUUGCAAGAAGAAUAUGGAAGGGAAGAUCGU<br>CCAGCCGGAGAACCUGGAAUACACUAUCGUGAUCACCCCGCACUCAGGCG<br>AGGAGAACGCAGUGGGCAACGAUACCGGGAAGCACGGGAAGGAAAUCAAG<br>GUGACCCCGCAGUCGUCCAUUACCGAGGCCGAACUCACCGGAUACGGCAC<br>UGUGACUAUGGAAUGCUCGCCACGGACCGGGCUGGAUUUCAAUGAGAUGG<br>UGCUCUUGCAAAUGGAGAACAAAGCCUGGCUGGUCCACCGCCAGUGGUUC<br>CUCGACCUCCCCCUUCCGUGGCUGCCGGGAGCUGACACCCAAGGAUCCAA<br>CUGGAUCCAAAAAGAAACCCUUGUCACGUUUAAGAAUCCACAUGCCAAAA<br>AGCAGGACGUGGUCGUGCUCGGAAGCCAGGAAGGAGCCAUGCACACUGCG<br>CUGACUGGAGCAACCGAAAUUCAAAUGUCGAGCGGCAACCUCCUCUUCAC<br>UGGACAUCUGAAGUGCCGGCUGCGCAUGGACAAACUGCAACUUAAGGGCA<br>UGUCAUACUCGAUGUGUACCGGCAAAUUCAAGGUGGUGAAGGAGAUCGCG<br>GAGACUCAGCACGGGACCAUCGUCAUCCGGGUCCAGUAUGAGGGUGAUGG<br>UUCCCCCUGCAAGAUCCCUUUCGAAAUCAUGGAUCUGGAGAAACGUCACG<br>UGCUGGGCCGGCUGAUCACUGUGAAUCCGAUCGUUACGGAGAAAGACAGC<br>CCGGUGAACAUCGAAGCUGAACCGCCGUUUGGGGAUAGCUACAUUAUCAU<br>CGGCGUGGAACCAGGCCAGCUCAAGUUGUCGUGGUUCAAGAAAGGAGGAG<br>GUGGAGGAUCCGGAGGCGGAGGGUCGGGCGGUGGUGGAUCGGAGGUCAAA<br>CUGCAGCAAUCAGGGACCGAAGUCGUGAAGCCGGGGGCUUCAGUCAAGCU<br>GUCCUGCAAGGCCAGCGGCUAUAUCUUCACUAGCUACGACAUCGAUUGGG<br>UGCGGCAGACUCCGGAGCAAGGACUCGAGUGGAUUGGGUGGAUCUUUCCG<br>GGCGAGGGAUCAACCGAGUACAACGAAAAAUUUAAGGGACGGGCAACGCU<br>GUCCGUGGACAAGAGCUCAUCUACGGCGUACAUGGAGCUGACGCGGCUCA<br>CGUCAGAGGAUUCCGCCGUCUACUUCUGUGCCAGGGGCGACUACUACCGG<br>CGCUACUUUGAUCUGUGGGGACAAGGAACGACCGUGACUGUCUCAUCAGG<br>CGGCGGCGGAUCGGGAGGAGGCGGAUCGGGUGGCGGUGGUUCGGACAUUC<br>AGAUGACUCAAUCGCCCAGCUUCCUGUCGACCUCACUGGGGAAUUCUAUU<br>ACGAUCACUUGUCACGCUUCGCAGAACAUCAAGGGUUGGCUGGCUUGGUA<br>CCAGCAGAAAAGCGGUAACGCCCCGCAACUGCUCAUCUACAAGGCAUCGU<br>CCCUGCAAUCGGGAGUGCCGUCACGCUUUUCAGGAUCGGGCUCCGGAACC<br>GAUUACAUCUUUACCAUCAGCAACCUGCAGCCGGAAGACAUCGCCACUUA<br>CUACUGUCAACACUAUCAGAGCUUUCCGUGGACCUUUGGAGGGGGGACCA<br>AAUUGGAGAUCAAGCGCGACUACAAGGAUGACGAUGACAAAUGAUAAUAG<br>GCUGGAGCCUCGGUGGCCAUGCUUCUUGCCCCUUGGGCCUCCCCCCAGCC<br>CCUCCUCCCCUUCCUGCACCCGUACCCCCGUGGUCUUUGAAUAAAGUCUG<br>AGUGGGCGGC | |
| | MDWTWILFLVAAATRVHSKGMSYSMCTGKFKVVKEIAETQHGTIVIRVQT<br>EGDGSPCKIPFEIMDLEKRHVLGRLITVNPIVTEKDSPVNIEAEPPFGDS<br>YIIIGVEPGQLKLNWFKKGSSIGQMFETTMRGAKRMAILSGGDIIKLLNE<br>QVNKEMQSSNLYMSMSSWCYTHSLDGAGLFLFDHAAEEYEHAKKLIIFLN<br>ENNVPVQLTSISAPEHKFEGLTQIFQKAYEHEQHISESINNIVDHAIKSK<br>DHATFNFLQWYVAEQHEEEVLFKDILDKIELIGNENHGLYLADQYVKGIA<br>KSRKS | 32 |
| | ATGGATTGGACCTGGATCTTGTTTCTCGTCGCCGCAGCCACTCGCGTTCA<br>TAGCAAAGGAATGTCATACTCCATGTGCACGGGAAAATTCAAGGTGGTCA<br>AAGAGATCGCGGAGACTCAGCACGGCACCATCGTCATTCGCGTGCAAACT<br>GAAGGAGATGGATCTCCCTGCAAGATCCCGTTCGAGATCATGGACCTGGA<br>AAAGAGACACGTCCTCGGTAGACTGATCACCGTGAACCCGATCGTGACGG<br>AGAAGGATTCCCCGGTGAATATTGAAGCAGAGCCTCCATTTGGGGACTCA<br>TACATTATCATTGGGGTCGAGCCGGGCCAGCTGAAGCTGAATTGGTTTAA<br>GAAGGGCTCGTCAATCGGACAGATGTTCGAAACTACTATGAGGGGTGCAA<br>AGCGGATGGCGATCCTCTCGGGCGGAGATATCATCAAACTCCTTAACGAA<br>CAGGTGAACAAGGAGATGCAGTCCTCAAACCTTTACATGAGCATGTCGTC<br>CTGGTGTTACACCCATAGCCTGGACGGCGCTGGATTGTTCCTGTTTGACC<br>ATGCAGCGGAGGAATACGAACACGCCAAGAAGCTCATCATCTTCCTGAAC<br>GAGAATAACGTGCCAGTGCAACTGACCTCCATCTCGGCTCCTGAGCACAA<br>GTTCGAAGGACTCACCCAGATCTTCCAAAAGGCCTACGAACACGAACAGC<br>ACATCAGCGAATCCATCAACAATATCGTGGACCATGCTATCAAAAGCAAA<br>GACCATGCGACCTTCAACTTCCTGCAATGGTATGTCGCCGAACAGCACGA<br>AGAGGAGGTGCTGTTCAAGGACATTCTCGACAAAATCGAATTGATAGGGA<br>ACGAAAATCACGGTCTGTACCTGGCCGATCAATACGTGAAGGGAATTGCC<br>AAGTCGCGGAAGTCGT | 33 |
| | GGGAAAUAAGAGAGAAAAGAAGAGUAAGAAGAAAUAUAAGAGCCACCAUG<br>GAUUGGACCUGGAUCUUGUUUCUCGUCGCCGCAGCCACUCGCGUUCAUAG<br>CAAAGGAAUGUCAUACUCCAUGUGCACGGGAAAAUUCAAGGUGGUCAAAG<br>AGAUCGCGGAGACUCAGCACGGCACCAUCGUCAUUCGCGUGCAAACUGAA<br>GGAGAUGGAUCUCCCUGCAAGAUCCCGUUCGAGAUCAUGGACCUGGAAAA<br>GAGACACGUCCUCGGUAGACUGAUCACCGUGAACCCGAUCGUGACGGAGA<br>AGGAUUCCCCGGUGAAUAUUGAAGCAGAGCCUCCAUUUGGGGACUCAUAC<br>AUUAUCAUUGGGGUCGAGCCGGGCCAGCUGAAGCUGAAUUGGUUUAAGAA<br>GGGCUCGUCAAUCGGACAGAUGUUCGAAACUACUAUGAGGGGUGCAAAGC | 34 |

TABLE 15-continued

| Name | Sequence | SEQ ID NO |
|---|---|---|
| | GGAUGGCGAUCCUCUCGGGCGGAGAUAUCAUCAAACUCCUUAACGAACAG<br>GUGAACAAGGAGAUGCAGUCCUCAAACCUUUACAUGAGCAUGUCGUCCUG<br>GUGUUACACCCAUAGCCUGGACGGCGCUGGAUUGUUCCUGUUUGACCAUG<br>CAGCGGAGGAAUACGAACACGCCAAGAAGCUCAUCAUCUUCCUGAACGAG<br>AAUAACGUGCCAGUGCAACUGACCUCCAUCUCGGCUCCUGAGCACAAGUU<br>CGAAGGACUCACCCAGAUCUUCCAAAAGGCCUACGAACACGAACAGCACA<br>UCAGCGAAUCCAUCAACAAUAUCGUGGACCAUGCUAUCAAAAGCAAAGAC<br>CAUGCGACCUUCAACUUCCUGCAAUGGUAUGUCGCCGAACAGCACGAAGA<br>GGAGGUGCUGUUCAAGGACAUUCUCGACAAAAUCGAAUUGAUAGGGAACG<br>AAAAUCACGGUCUGUACCUGGCCGAUCAAUACGUGAAGGGAAUUGCCAAG<br>UCGCGGAAGUCGUGAUAAUAGGCUGGAGCCUCGGUGGCCAUGCUUCUUGC<br>CCCUUGGGCCUCCCCCCAGCCCCUCCUCCCCUUCCUGCACCCGUACCCCC<br>GUGGUCUUUGAAUAAAGUCUGAGUGGGCGGCU | |

Mice were vaccinated on weeks 0 and 3 via intramuscular (IM) or intradermal (ID) routes. One group remained unvaccinated and one was administered $10^5$ plaque-forming units (PFU) live DENV2, D2Y98P isolate via intravenous (IV) injection as a positive control. Serum was collected from each mouse on weeks 1, 3, and 5; bleeds on weeks 1 and 3 were in-life samples (tail vein or submandibular bleeds) and week 5 will be a terminal (intracardiac) bleed. Individual serum samples were stored at −80° C. until analysis by neutralization or microneutralization assay. Pooled samples from each group at the week 5 time points were tested by Western blot for reactivity with viral lysate.

TABLE 16

Detailed experimental design (treatment, readouts)

| Group | Mouse Strain | Vaccine (n = 10, female) mice/group) Delivered week 0 and 3 | Chemistry | Formulation/ Route | Dose | Readouts |
|---|---|---|---|---|---|---|
| 1 | Female | N/A | | N/A | N/A | Serum |
| 2 | BALB/c | DEN2Y98-PrME | N1-methyl- | ID | 0.4 | samples |
| 3 | 6-8 | (construct 1 | pseudouridine/ | IM | mg/kg | collected |
| | weeks | from Table 14) | 5-methyl- | | in LNP | on weeks |
| 4 | of age | | cytosine | ID | 0.08 | 1, 3, and 5. |
| 5 | | | | IM | mg/kg | Serum |
| | | | | | in LNP | analyzed |
| 6 | | | | ID | 0.016 | via |
| 7 | | | | IM | mg/kg | Western |
| | | | | | in LNP | blot |
| 8 | | | N1-methyl- | ID | 0.4 | |
| 9 | | | pseudouridine | IM | mg/kg | |
| | | | | | in LNP | |
| 10 | | | | ID | 0.08 | |
| 11 | | | | IM | mg/kg | |
| | | | | | in LNP | |
| 11 | | | | ID | 0.016 | |
| 12 | | | | IM | mg/kg | |
| | | | | | in LNP | |
| 13 | | DEN2Y98-PrME80 | N1-methyl- | ID | 0.4 | |
| 14 | | (construct 2 | pseudouridine/ | IM | mg/kg | |
| | | from Table 14) | 5-methyl- | | in LNP | |
| 15 | | | cytosine | ID | 0.08 | |
| 16 | | | | IM | mg/kg | |
| | | | | | in LNP | |
| 17 | | | | ID | 0.016 | |
| 18 | | | | IM | mg/kg | |
| | | | | | in LNP | |
| 19 | | | N1-methyl- | ID | 0.4 | |
| 20 | | | pseudouridine | IM | mg/kg | |
| | | | | | in LNP | |
| 21 | | | | ID | 0.08 | |
| 22 | | | | IM | mg/kg | |
| | | | | | in LNP | |
| 23 | | | | ID | 0.016 | |
| 24 | | | | IM | mg/kg | |
| | | | | | in LNP | |
| 25 | | DEN2Y98- | N1-methyl- | ID | 0.4 | |
| 26 | | PrME80-DC | pseudouridine/ | IM | mg/kg | |
| | | (construct 3 | 5-methyl- | | in LNP | |

TABLE 16-continued

Detailed experimental design (treatment, readouts)

| Group | Mouse Strain | Vaccine (n = 10, female) mice/group) Delivered week 0 and 3 | Chemistry | Formulation/ Route | Dose | Readouts |
|---|---|---|---|---|---|---|
| 27 | | from Table 14) | cytosine | ID | 0.08 | |
| 28 | | | | IM | mg/kg in LNP | |
| 29 | | | | ID | 0.016 | |
| 30 | | | | IM | mg/kg in LNP | |
| 31 | | | N1-methyl- | ID | 0.4 | |
| 32 | | | pseudouridine | IM | mg/kg in LNP | |
| 33 | | | | ID | 0.08 | |
| 34 | | | | IM | mg/kg in LNP | |
| 35 | | | | ID | 0.016 | |
| 36 | | | | IM | mg/kg in LNP | |
| 37 | | DEN2-DIII- | N1-methyl- | ID | 0.4 | |
| 38 | | Ferritin (construct 4 | pseudouridine | IM | mg/kg in LNP | |
| 39 | | from Table 14) | | ID | 0.08 | |
| 40 | | | | IM | mg/kg in LNP | |
| 41 | | | | ID | 0.016 | |
| 42 | | | | IM | mg/kg in LNP | |
| 43 | | Control, D2Y98P live virus | — | IV | $10^5$ PFU | |

Signal was detected in groups 5, 15, 39, and 44 (live virus control) by a band that appeared between 50 and 60 kDa in the Western blot data. The data suggests that a mRNA vaccine to a single dengue viral antigen can produce antibody in preliminary studies.

In order to provide a Dengue vaccine having enhanced immunogenicity, RNA vaccines for concatemeric antigens were designed and tested according to the invention. These vaccines, which have significantly enhanced activity, in comparison to the single protein antigens described herein, are described below.

Example 20: In Silico Prediction of T Cell Epitopes for RNA Vaccine Design

Several peptide epitopes from Dengue virus were generated and tested for antigenic activity. The peptide epitopes are designed to maximize MHC presentation. In general the process of MHC class I presentation is quite inefficient, with only 1 peptide of 10,000 degraded molecules actually being presented. Additionally the priming of CD8 T cell with APCs having insufficient densities of surface peptide/MHC class I complexes results in weak responders exhibiting impaired cytokine secretion and a decrease memory pool. Thus, the process of designing highly effective peptide epitopes is important to the immunogenicity of the ultimate vaccine.

In silico prediction of desirable peptide epitopes was performed using Immune Epitope Database. Using this database several immunogenic Dengue T cell epitopes showing strong homology across all 4 Dengue serotypes were predicted. Examples of these epitopes are shown in FIGS. 16A-16C and 17A-17C.

Example 21: Prediction of DENY T Cell Epitopes for RNA Vaccine Design

The design of optimized vaccination systems to prevent or treat conditions that have failed to respond to more traditional treatments or early vaccination strategies relies on the identification of the antigens or epitopes that play a role in these conditions and which the immune system can effectively target. T cell epitopes (e.g., MHC peptide binding) for the various alleles shown in Table 17 were determined using Rapid Epitope Discovery System (ProImmune REVEAL & ProVE®). This system is used to identify those candidate epitopes that actually cause relevant immune responses from the numerous other potential candidates identified using algorithms to predict MHC-peptide binding. The REVEAL binding assay determines the ability of each candidate peptide to bind to one or more MHC I class alleles and stabilize the MHC-peptide complex. The assay identifies the most likely immunogenic peptides in a protein sequence by comparing the binding to that of a high affinity T cell epitope and detecting the presence or absence of the native conformation of the MHC-peptide complex. The epitope peptides are further tested using the assays described herein to confirm their immunogenic activity.

TABLE 17

| Alleles Tested Allele |
|---|
| A*01:01 |
| A*02:01 |
| A*03:01 |
| A*11:01 |
| A*24:02 |

TABLE 17-continued

| Alleles Tested Allele |
| --- |
| B*07:02 |
| B*27:05 |
| H-2Kb |

TABLE 18

ProImmune REVEAL ® binding assay data for A*01:01

| Peptide I.D. | SEQ ID NO | REVEAL ® score at 0 h |
| --- | --- | --- |
| TTDISEMGA | 217 | 68.4 |

TABLE 19

ProImmune REVEAL ® binding assay data for A*02:01

| Peptide I.D. | SEQ ID NO | REVEAL ® score at 0 h |
| --- | --- | --- |
| TMWHVTRGA | 218 | 112.0 |
| MWHVTRGAV | 219 | 62.7 |
| GLYGNGVVT | 220 | 87.7 |
| TLILAPTRV | 221 | 104.2 |
| LILAPTRVV | 222 | 106.4 |
| ILAPTRVVA | 223 | 95.7 |
| VVAAEMEEA | 224 | 92.2 |
| IVDLMCHAT | 225 | 62.7 |
| LMCHATFTM | 226 | 72.9 |
| MGEAAAIFM | 227 | 50.6 |
| GEAAAIFMT | 228 | 74.3 |
| KTVWFVPSI | 229 | 115.9 |
| LMRRGDLPV | 230 | 82.3 |
| TLLCDIGES | 231 | 63.9 |
| LLCDIGESS | 232 | 93.9 |
| AMTDTTPFG | 233 | 91.9 |
| GQQRVFKEK | 234 | 47.1 |
| KLTYQNKVV | 235 | 92.3 |
| AISGDDCVV | 236 | 91.1 |
| LMYFHRRDL | 237 | 97.8 |

TABLE 20

ProImmune REVEAL ® binding assay data for A*03:01

| Peptide I.D. | SEQ ID NO | REVEAL ® score at 0 h |
| --- | --- | --- |
| RTLILAPTR | 238 | 91.4 |
| TLILAPTRV | 239 | 55.2 |
| MCHATFTMR | 240 | 86.8 |
| TVWFVPSIK | 241 | 53.6 |
| GQQRVFKEK | 242 | 59.6 |
| CVYNMMGKR | 243 | 81.6 |

TABLE 21

ProImmune REVEAL ® binding assay data for A*11:01

| Peptide I.D. | SEQ ID NO | REVEAL ® score at 0 h |
| --- | --- | --- |
| HTMWHVTRG | 244 | 56.3 |
| RTLILAPTR | 245 | 89.9 |
| TLILAPTRV | 246 | 59.0 |
| MCHATFTMR | 247 | 91.0 |
| ATFTMRLLS | 248 | 58.5 |
| GEAAAIFMT | 249 | 50.3 |
| KTVWFVPSI | 250 | 50.8 |
| TVWFVPSIK | 251 | 92.2 |
| GQQRVFKEK | 252 | 85.5 |
| CVYNMMGKR | 253 | 113.2 |
| VYNMMGKRE | 254 | 62.5 |
| YNMMGKREK | 255 | 80.9 |
| NMMGKREKK | 256 | 77.9 |
| GTYGLNTFT | 257 | 63.6 |

Table 22

ProImmune REVEAL ® binding assay data for A*24:02

| Peptide I.D. | SEQ ID NO | REVEAL ® score at 0 h |
| --- | --- | --- |
| LMCHATFTM | 259 | 99.5 |
| CHATFTMRL | 260 | 75.9 |
| GEAAAIFMT | 261 | 58.9 |
| KTVWFVPSI | 262 | 89.1 |
| HWTEAKMLL | 263 | 103.2 |
| WTEAKMLLD | 264 | 94.7 |
| LGCGRGGWS | 265 | 74.8 |
| MAMTDTTPF | 266 | 51.3 |
| MYADDTAGW | 267 | 76.8 |
| VGTYGLNTF | 268 | 96.0 |
| YFHRRDLRL | 269 | 87.5 |

TABLE 23

ProImmune REVEAL ® binding assay data for B*07:02

| Peptide I.D. | SEQ ID NO | REVEAL ® score at 0 h |
|---|---|---|
| FKPGTSGSP | 270 | 50.4 |
| KPGTSGSPI | 271 | 112.1 |
| IPERSWNSG | 272 | 45.2 |
| PERVILAGP | 273 | 56.1 |
| LMRRGDLPV | 274 | 178.9 |
| PLSRNSTHE | 275 | 65.0 |
| LSRNSTHEM | 276 | 124.5 |
| SRNSTHEMY | 277 | 52.0 |
| MAMTDTTPF | 278 | 117.4 |
| TPFGQQRVF | 279 | 112.7 |
| LMYFHRRDL | 280 | 119.6 |

TABLE 24

ProImmune REVEAL ® binding assay data for B*27:05

| Peptide I.D. | SEQ ID NO | REVEAL ® score at 0 h |
|---|---|---|
| LRTLILAPT | 281 | 58.7 |
| LMCHATFTM | 282 | 98.2 |
| ARGYISTRV | 283 | 125.3 |
| RRGDLPVWL | 284 | 144.8 |
| GQQRVFKEK | 285 | 95.4 |
| SRAIWYMWL | 286 | 53.9 |
| FKLTYQNKV | 287 | 53.7 |

TABLE 25

ProImmune REVEAL ® binding assay data for H-2Kb

| Peptide I.D. | SEQ ID NO | REVEAL ® score at 0 h |
|---|---|---|
| FKPGTSGSP | 288 | 45.7 |
| LAPTRVVAA | 289 | 102.5 |
| LMCHATFTM | 290 | 59.0 |
| CHATFTMRL | 291 | 60.3 |
| HATFTMRLL | 292 | 69.5 |
| ATFTMRLLS | 293 | 55.6 |
| KTVWFVPSI | 294 | 54.4 |
| LSRNSTHEM | 295 | 51.1 |
| QQRVFKEKV | 296 | 63.4 |

TABLE 25-continued

ProImmune REVEAL ® binding assay data for H-2Kb

| Peptide I.D. | SEQ ID NO | REVEAL ® score at 0 h |
|---|---|---|
| YGLNTFTNM | 297 | 75.4 |
| LMYFHRRDL | 298 | 54.9 |

Example 22: Activity Testing for Predicted Peptide Epitopes

Exemplary peptide epitopes selected using the methods described above were further characterized. These peptide epitopes were confirmed to have activity using in vitro HLA binding assays (human lymphocyte binding assays). Peptides (9 aa peptides from the dengue antigen) were screened for their ability to bind to HLA. The analysis of the homology, affinity, frequency and design of these peptides is shown in FIGS. 16A-16C and 17A-17C.

Example 23: In Vivo Analysis of Mimectopes of Predicted Human Epitopes RNA Vaccines Methods IFNγ ELISpot. Mouse IFNγ ELISpot assays were performed using IFNγ coated Millipore IP Opaque plates according to the manufacturer's mouse IFNγ ELISPOT guidelines. Briefly, the plates were blocked using complete RPMI (R10) and incubated for 30 minutes prior to plating cells. Peptides (284-292, 408-419 or 540-548) were diluted to 5 different concentrations for stimulation at 5, −6, −7, −8, or −9 from an original stock concentration of 10 mM (−2). Mouse splenocytes (200,000-250,000 cells) were plated in appropriate wells with peptide, PMA+lonomycin or R10 media alone. Cells were stimulated in a total volume of 125 μL per well. Plates were then incubated at 37° C., 5% $CO_2$ for 18-24 hrs. Plates were developed following the manufacturer's instructions. Plates were counted and quality controlled using the automated ELISPOT reader CTL ImmunoSpot/FluoroSpot.

Intracellular Cytokine Staining (ICS). Intracellular Cytokine Staining (ICS). For intracellular cytokine staining, individual splenocytes, were resuspended at a concentration of 1.5×106 cells per mL. Peptides (284-292, 408-419 or 540-548) were made into 5 dilutions from a stock concentration of 10 $mM^{(-2)}$. The final concentrations of each peptide were −5, −6, −7, −8, or −9 in their respective wells. Cells were stimulated in a final volume of 200 uL within a 96 well culture plate. After the addition of Golgi plug (0.2 uL per well), cells were incubated at 37° C., 5% $CO_2$ for 5 hours. Following stimulation, cells were surface stained, fixed, washed and put at 4° C. overnight. Intracellular staining was performed the following day, resulting in full panel of Live/Dead (Invitrogen), αCD3, αCD4, αCD8, αCD45, αCCR7, αCD44, αCD25, αIL-2, αIFNγ, and αTNFα (BD Biosciences). Cells were acquired in a 96-U bottom plate using BD LSR Fortessa HTS (BD Biosciences).

Results

The exemplary peptide epitopes selected using the methods described herein were used to produce tests mouse mimectopes of the predicted human epitopes. These mimectopes were analyzed for in vivo activity using restimulation assays during the acute phase of Dengue infection (Day 7). The methods were performed on dengue-infected IFNαβ/γ-receptor-deficient mice (AG129). Seven days post infection splenocytes were harvested and subjected to an ELISPOT assay to quantify secretion of cytokines by T cells (CD8) as described above. Briefly, the isolated splenocytes were stimulated with the test peptides and tested for T cell activation. If the peptide is an appropriate antigen, some cells would be present antigen during infection and would be capable of stimulating T cells. The methods for analyzing the T cell activation were performed as follows:

T cells (at a known concentration) were incubated with a specific antigen in a cell culture well the activated T cells were transferred to ELISPOT plates (precoated with anti-cytokine antibody)

the cells were incubated such that cytokines could be secreted the cells were washed off the plate and enzyme coupled secondary Ig was added the plates were washed and substrate was added positive spots were scored under microscope.

Figure 18:
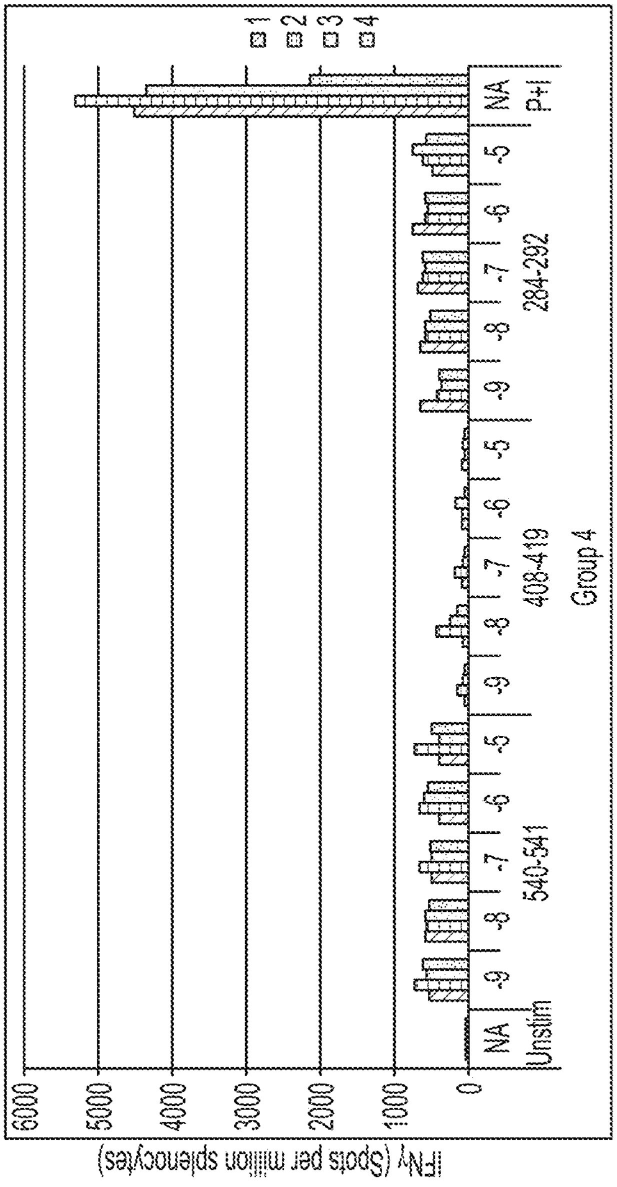
FIG. 18 is a graph depicting the results of an ELISPOT assay of dengue-specific peptides.
Figure 19:
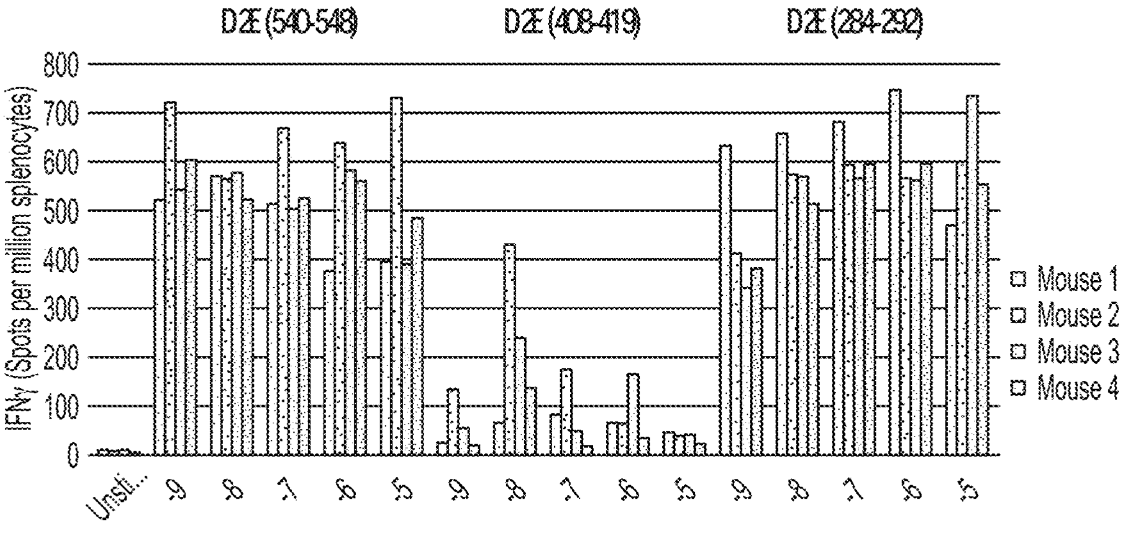
FIG. 19 is a graph depicting the results of an ELISPOT assay of dengue-specific peptides.

The data is shown in FIGS. 18-19. FIGS. 18 and 19 are graphs depicting the results of an ELISPOT assay of dengue-specific peptides measuring IFN-γ (spots per million splenocytes).

A schematic of an assay on a BLT Mouse Model (Bone Marrow/Liver/Thymus) is shown in FIG. 20. The results of a histogram analysis of human CD8 T cells stimulated with peptide epitope is also shown in FIG. 20.

The following two sequences were used as controls:

```
(V5)8-cathb:
                                    (SEQ ID NO: 35)
Kozak Start GKPIPNPLLGLDST-GFLG-GKPIPNPLLGLDST-
GFLG-GKPIPNPLLGLDST-GFLG-GKPIPNPLLGLDST-GFLG-
GKPIPNPLLGLDST-GFLG-GKPIPNPLLGLDST-GFLG-
GKPIPNPLLGLDST-GFLG-GKPIPNPLLGLDST Stop

(v5)8-cathb + MHCi:
                                    (SEQ ID NO: 36)
Kozak Start GKPIPNPLLGLDST-GFLG-GKPIPNPLLGLDST-
GFLG-GKPIPNPLLGLDST-GFLG-GKPIPNPLLGLDST-GFLG-
GKPIPNPLLGLDST-GFLG-GKPIPNPLLGLDST-GFLG-
GKPIPNPLLGLDST-GFLG-GKPIPNPLLGLDST Stop
```

Some results are shown in Table 26:

TABLE 26

| | Results A*02:01 | |
|---|---|---|
| Peptide ID | REVEAL ® Score | |
| 5. K Q W F L D L P L (SEQ ID NO: 213) | 86.0 | |
| 6. R Q W F L D L P L (SEQ ID NO: 214) | 77.7 | |
| 7. R Q W F F D L P L (SEQ ID NO: 215) | 80.5 | |
| 8. T A L T G A T E I (SEQ ID NO: 216) | 0.9 | |
| **Positive Control** | **100.** | +/- |

Example 24: AG129 Mouse Challenge of Mimectopes of Predicted Human Epitopes from DENV2

A study is performed on AG129 mouse using a cocktail of 2 peptide epitopes. The immunogenicity of the peptide epitopes is determined in AG129 mice against challenge with a lethal dose of mouse-adapted DENV 2 strain D2Y98P. AG129 mice, which lack IFN α/β and γ receptor signaling, injected intradermally in the footpad with $10^4$ PFU of DENV do not survive past day 5 post-injection. AG129 mice are vaccinated via intramuscular (IM) injection with either 2 μg or 10 μg of a cocktail of 2 peptide epitopes. The vaccines are given to AG129 mice with a prime and a boost (day 0 and day 28). The positive control group is vaccinated with heat-inactivated DENV 2. Phosphate-buffered saline (PBS) is used as a negative control. On day 56, mice are challenged with mouse-adapted DENV 2 and monitored for 10 days for weight loss, morbidity, and mortality. Mice that display severe illness, defined as >30% weight loss, a health score of 6 or above, extreme lethargy, and/or paralysis are euthanized.

Example 25: "Humanized" DENV Peptides Mouse Immunogenicity Study

A study analyzing immunogenicity of the peptide epitopes on humanized mice is performed. A single-dose cocktail (30 μg) containing 3 different peptide epitopes are delivered by IM route of immunization with prime and boost (day 0, day 28). A T cell (ELISPOT and ICS) characterization may be performed on Day 7, Day 28, and Day 56.

Example 26: Testing of Non-Human Primate (NHP) Mimectopes of Predicted DENY Human Epitopes Non-human primate (NHP) mimectopes to the human epitopes may also be developed and tested for activity in NHP assays. The NHP mimectopes are designed based on the human antigen sequence. These mimectopes may be analyzed for in vivo activity in an NHP model using, for instance, restimulation assays. Once the NHPs have been infected, immune cells may be isolated and tested for sensitivity of activation by the particular mimectopes.

Figure 21:
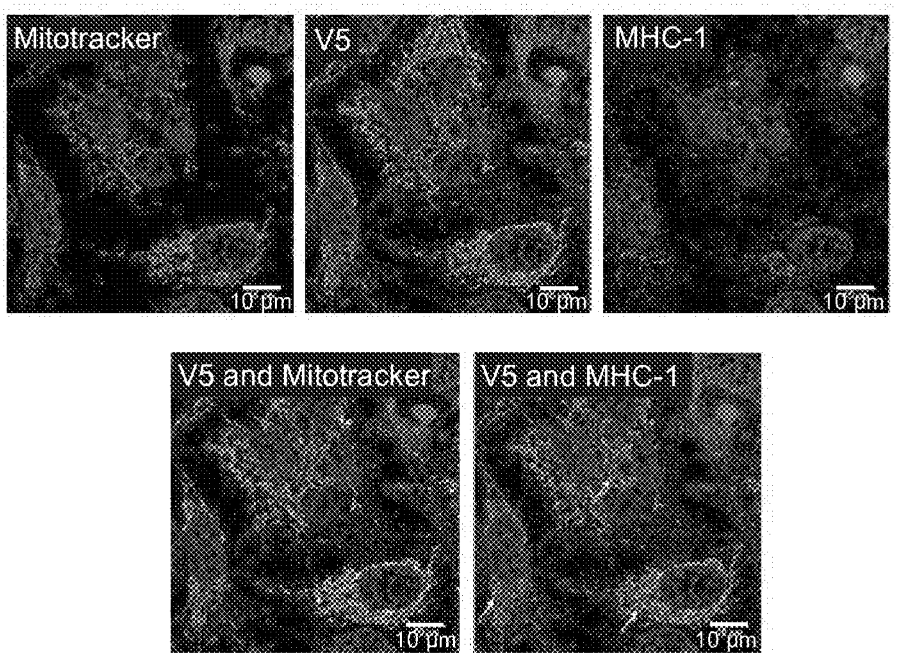
FIG. 21 shows DENV MHC-1_V5 concatemer transfection in HeLa cells. Triple immunofluorescence using Mitotracker Red (mitochondria), anti-V5, and anti-MHC-1 antibodies plus DAPI was performed. The arrows indicate V5-MHC1 colocalization (bottom right).
Figure 22:
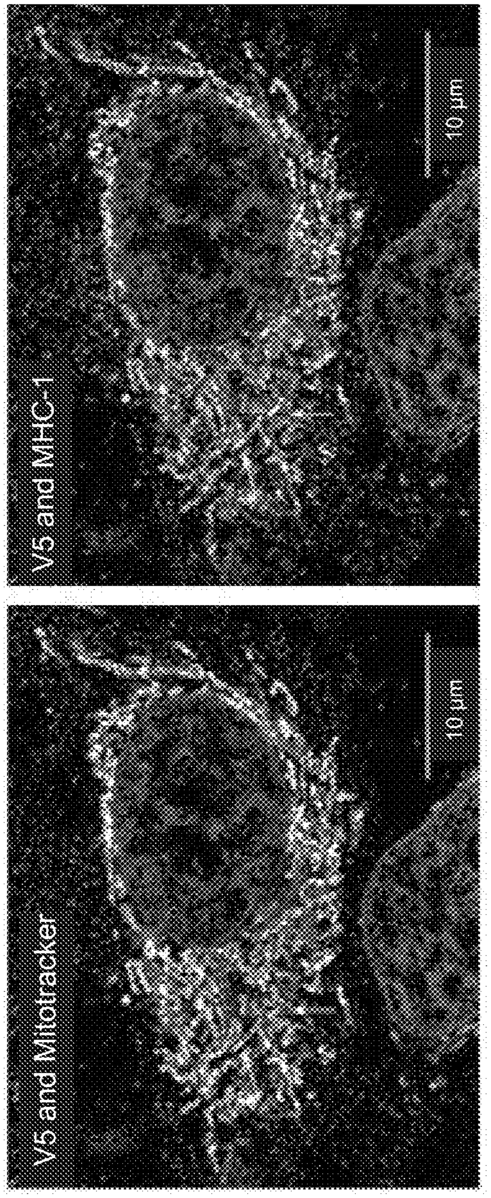
FIG. 22 shows DENV MHC-1_V5 concatemer transfection in HeLa cells. Triple immunofluorescence using Mitotracker Red (mitochondria), anti-V5, and anti-MHC-1 antibodies plus DAPI was performed. The arrows indicate regions where V5 preferentially colocalizes with MHC1 and not with Mitotracker.
Figure 23:
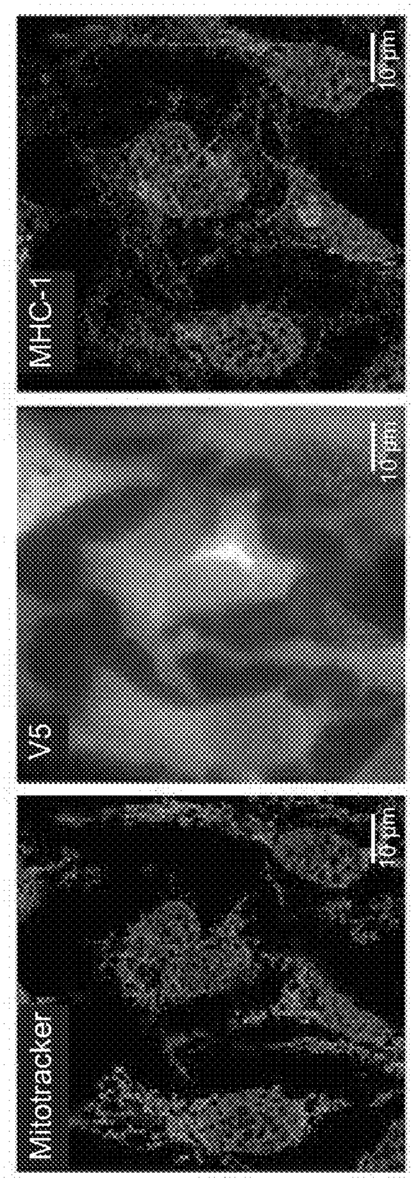
FIG. 23 shows DENV MHC-1_V5 concatemer transfection in HeLa cells. Triple immunofluorescence using Mitotracker Red (mitochondria), anti-V5, and anti-MHC-1 antibodies plus Dapi was performed. V5 has homogeneous cytoplasmic distribution preferentially colocalizes with MHC1 and not with Mitotracker.

Example 27: Targeting of DENY Concatemeric Constructs Using Cytoplasmic Domain of MHC I MHC-1_V5 concatemer constructs were developed and transfected in HeLa cells. Triple immunofluorescence using Mitotracker Red (mitochondria), anti-V5, and anti-MHC-1 antibodies plus Dapi was performed. The data is shown in FIGS. 21-23. FIG. 21 shows MHC-1_V5 concatemer transfection in HeLa cells. The arrows indicate V5-MHC1 colocalization (bottom right). FIG. 22 shows MHC-1_V5 concatemer transfection. The arrows indicate regions where V5 preferentially colocalizes with MHC1 and not with Mitotracker. FIG. 23 shows V5 concatemer transfection in HeLa cells. V5 has homogeneous cytoplasmic distribution preferentially colocalizes with MHC1 and not with Mitotracker. These data demonstrate that the V5 concatemer with the cytoplasmic domain from MHC class I co-localizes with MHC class I expression (FIG. 21), while the V5 concatemer without this sequence is only found in the cytoplasm (FIG. 23) following transfection in HeLa cells.

Example 28: In Vivo Analysis of DENY Concatemeric mRNA Epitope Construct

The Dengue concatemers used in this study consist of 8 repeats of the peptide TALGATEI (SEQ ID NO: 299), a mouse CD8 T cell epitope found in the DENV2 envelope. The peptide repeats were linked via cathepsin B cleavage sites and modified with the various sequences as follows:

(1) TALGATEI (SEQ ID NO: 299) peptide concatemer with no modification
(2) TALGATEI (SEQ ID NO: 299) peptide concatemer with IgKappa signal peptide
(3) TALGATEI (SEQ ID NO: 299) peptide concatemer with PEST sequence
(4) TALGATEI (SEQ ID NO: 299) peptide concatemer with IgKappa signal peptide and PEST sequence
(5) TALGATEI (SEQ ID NO: 299) peptide concatemer with MHC class I cytoplasmic domain
(6) TALGATEI (SEQ ID NO: 299) peptide concatemer with IgKappa signal peptide and MHC class I cytoplasmic domain
(7) Heat-inactivated DENV2 (D2Y98P)
(8) No immunization The immunogenicity of the peptide concatemeric candidate vaccines were determined in AG129 mice against challenge with a lethal dose of DENV strain D2Y98P. AG129 mice, which lack IFN $\alpha/\beta$ and $\gamma$ receptor signaling, injected intradermally in the footpad with $10^4$ PFU of DENV do not survive past day 5 post-injection. (In this study, the mice died due to a problem with the heat-attenuation). The tested vaccines included constructs (1)-(8) disclosed above. AG129 mice were vaccinated via intramuscular (IM) injection with either 2 μg or 10 μg of the candidate vaccine. The vaccines were given to AG129 mice as a prime and a boost (second dose provided 28 days after the first dose). The positive control group was vaccinated with heat-inactivated DENV 2. Phosphate-buffered saline (PBS) was used as a negative control.

On day 56, mice were challenged with mouse-adapted DENV 2 and monitored for 10 days for weight loss, morbidity, and mortality. Mice that displayed severe illness, defined as >30% weight loss, a health score of 6 or above, extreme lethargy, and/or paralysis were euthanized. Notably, mice "vaccinated" with heat-inactivated DENV (positive control group) became morbid and died (they were not included in the challenge portion of the study).

In addition, individual serum samples were collected prior to challenge on day 54 and PBMCs were isolated and frozen for subsequent testing.

Figure 24A:
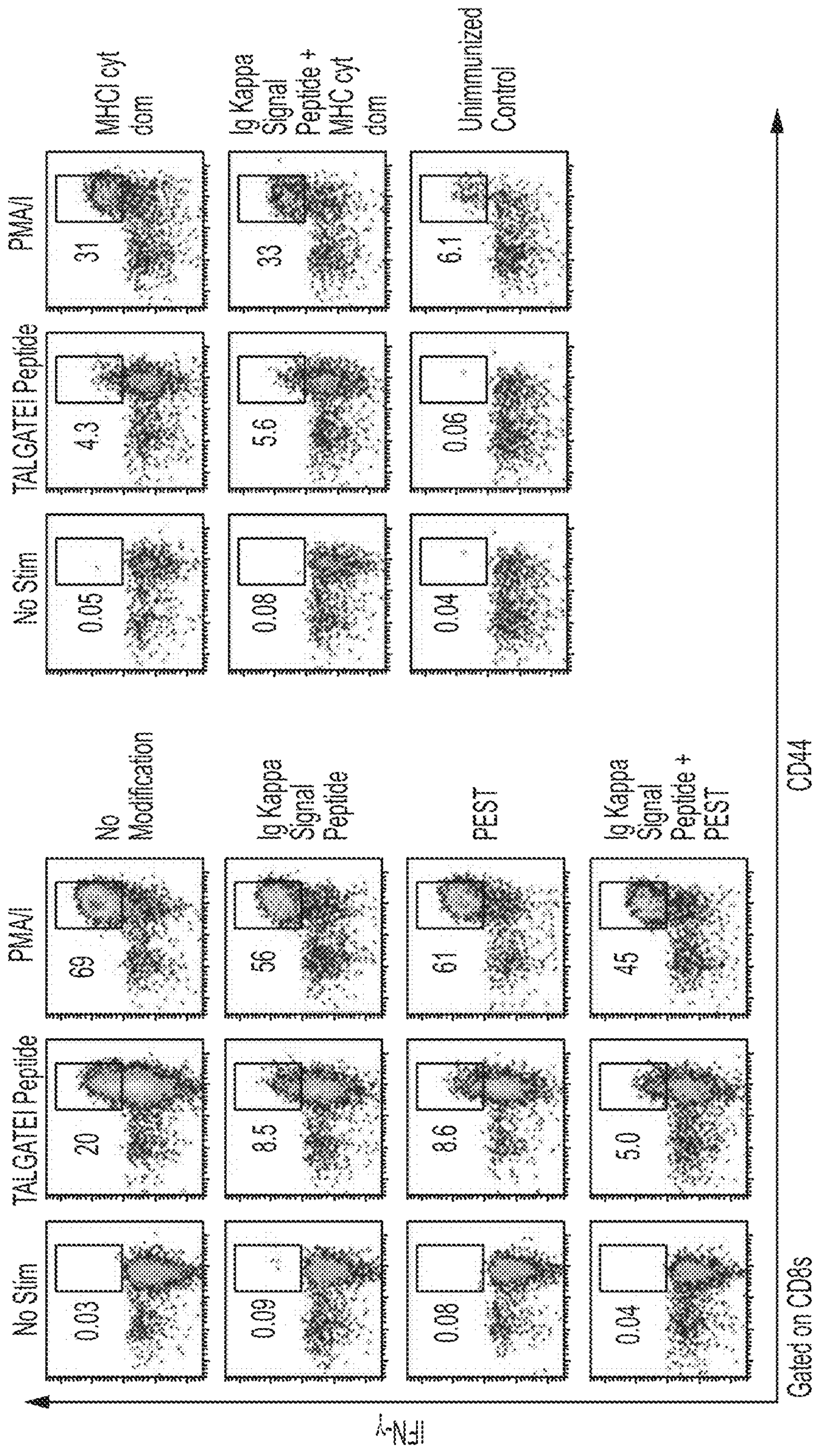
FIGS. 24A and 24B shows the results of an Intracellular Cytokine Staining assay performed in PBMC cells.
Figure 24B:
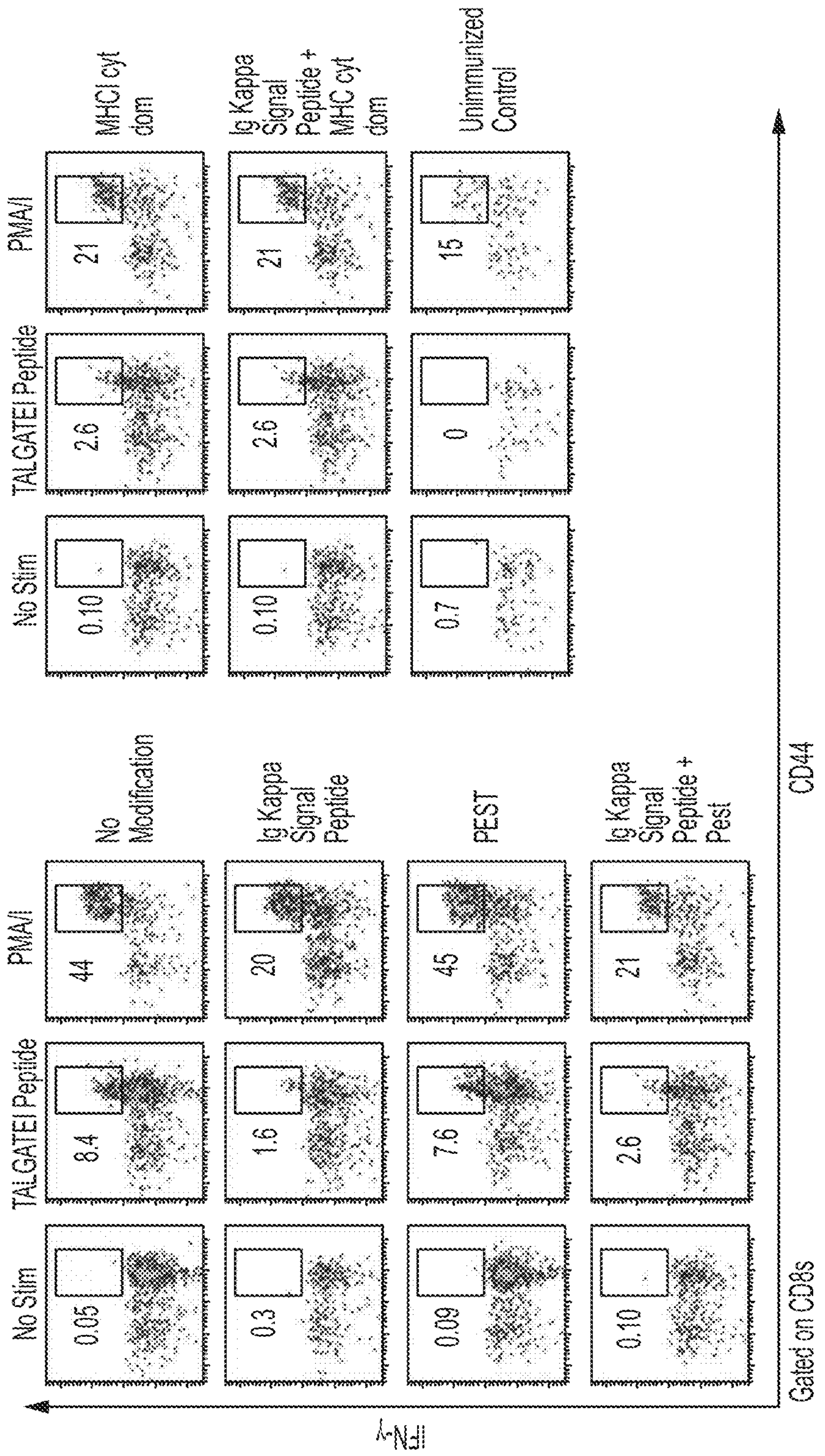
Figure 25:
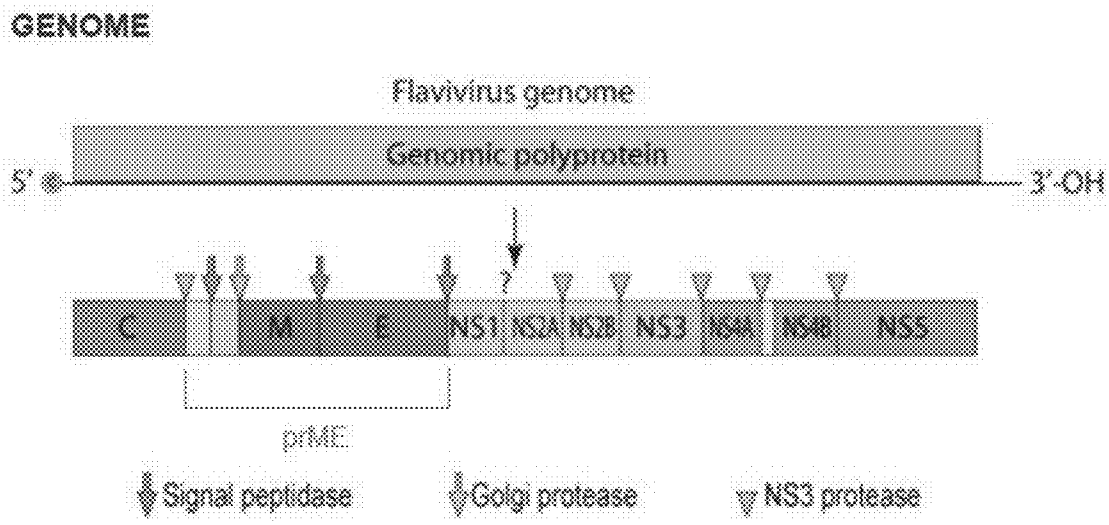
FIG. 25 shows a schematic of a genomic polyprotein obtained from Zika virus, *Flaviridiaie*. The ZIKV genome encodes a polyprotein with three structural proteins (capsid (C), premembrane/membrane (prM), and envelope (E, a glycosylation motif previously associated with virulence)), and seven nonstructural proteins (NS1, NS2A, NS2B, NS3, NS4A, NS4B and NS5). The polyprotein may be cleaved by several host peptidase or proteases to generate structural or functional proteins for the virus. The respective cleavage sites of the peptidases or proteases are indicated by arrows.

The AG129 mice PBMCs were thawed and stimulated with TALGATEI (SEQ ID NO: 299) peptide for 5 hours in a standard intracellular cytokine assay. For intracellular cytokine staining, PBMCs were thawed and suspended in media. The TALGATEI (SEQ ID NO: 299) peptide was administered to stimulate the cells. After the addition of Golgi plug, cells were incubated at 37° C., 5% CO2 for 5 hours. Following stimulation, cells were surface stained, fixed, washed and put at 4° C. overnight. Intracellular staining was performed the following day and assayed via ELISPOT assay to quantify secretion of cytokines by T cells (CD8) as described above to determine T cell activation. If the peptide is an appropriate antigen, some cells would be present antigen during infection and would be capable of stimulating T cells. The results are shown in FIGS. 24A and 24B, which demonstrate that each of the peptides (1)-(6) stimulate T cell activation.

Example 29: Exemplary CHIKV Polypeptides

The amino acids presented in the Table 27 are exemplary CHIKV antigenic polypeptides. To the extent that any exemplary antigenic peptide described herein includes a flag tag or V5, or a polynucleotide encodes a flag tag or V5, the skilled artisan understands that such flag tag or V5 is excluded from the antigenic polynucleotide in a vaccine formulation. Thus, any of the polynucleotides encoding proteins described herein are encompassed within the compositions of the invention without the flag tag or V5 sequence.

TABLE 27

| Antigen identifier | Amino acid sequence |
|---|---|
| SE_chikv-Brazillian-E1_KP164567-71_72 | MYEHVTVIPNTVGVPYKTLVNRPGYSPMVLEMELLSVTLEPTLSLDYITCEYKTVIPSPYVK CCGTAECKDKSLPDYSCKVFTGVYPFMWGGAYCFCDTENTQLSEAHVEKSESCKTEFASAYR AHTASASAKLRVLYQGNNITVAAYANGDHAVTVKDAKFIVGPMSSAWTPFDNKIVVYKGDVY NMDYPPFGAGRPGQFGDIQSRTPESEDVYANTQLVLQRPSAGTVHVPYSQAPSGFKYWLKER GASLQHTAPFGCQIATNPVRAMNCAVGNMPISIDIPDAAFTRVVDAPSLTDMSCEVSACTHS SDFGGVAIIKYAASKKGKCAVHSMTNAVTIREAEIEVEGNSQLQISFSTALASAEFRVQVCS TQVHCAAECHPPKDHIVNYPASHTTLGVQDISATAMSWVQKITGGVGLVVAVAALILIVVLC VSFSRH (SEQ ID NO. 37) |
| SE_chikv-Brazillian-E1_KP164568-69_70 | MYEHVTVIPNTVGVPYKTLVNRPGYSPMVLEMELLSVTLEPTLSLDYITCEYKTVIPSPYVK CCGTAECKDKNLPDYSCKVFTGVYPFMWGGAYCFCDAENTQLSEAHVEKSESCKTEFASAYR AHTASASAKLRVLYQGNNITVTAYANGDHAVTVKDAKFIVGPMSSAWTPFDNKIVVYKGDVY NMDYPPFGAGRPGQFGDIQSRTPESKDVYANTQLVLQRPAAGTVHVPYSQAPSGFKYWLKER GASLQHTAPFGCQIATNPVRAVNCAVGNMPISIDIPDAAFIRVVDAPSLTDMSCEVPACTHS SDFGGVAIIKYAASKKGKCAVHSMTNAVTIREAEIEVEGNSQLQISFSTALASAEFRVQVCS TQVHCVAECHPPKDHIVNYPASHTTLGVQDISATALSWVQKITGGVGLVVAVAALILIVVLC VSFSRH (SEQ ID NO. 38) |
| SE_chikv-Brazillian-E2-E1_KP164567-71_72 | MSIKDHFNVYKATRPYLAHCPDCGEGHSCHSPVALERIRNEATDGTLKIQVSLQIGIKTDDS HDWTKLRYMDNHMPADAERAGLFVRTSAPCTITGTMGHFILARCPKGETLTVGFTDGRKISH SCTHPFHHDPPVIGREKFHSRPQHGRELPCSTYAQSTAATAEEIEVHMPPDTPDRTLMSQQS GNVKITVNSQTVRYKCNCGDSSEGLTTTDKVINNCKVDQCHAAVTNHKKWQYNSPLVPRNAE FGDRKGKVHIPFPLANVTCRVPKARNPTVTYGKNQVIMLLYPDHPTLLSYRNMGEEPNYQEE WVTHKKEIRLTVPTEGLEVTWGNNEPYKYWPQLSTNGTAHGHPHEIILYYYELYPTMTAVVL SVASFILLSMVGVAVGMCMCARRRCITPYELTPGATVPFLLSLICCIRTAKAYEHVTVIPNT VGVPYKTLVNRPGYSPMVLEMELLSVTLEPTLSLDYITCEYKTVIPSPYVKCCGTAECKDKS LPDYSCKVFTGVYPFMWGGAYCFCDTENTQLSEAHVEKSESCKTEFASAYRAHTASASAKLR |

TABLE 27-continued

| Antigen identifier | Amino acid sequence |
|---|---|
| | VLYQGNNITVAAYANGDHAVTVKDAKFIVGPMSSAWTPFDNKIVVYKGDVYNMDYPPFGAGR<br>PGQFGDIQSRTPESEDVYANTQLVLQRPSAGTVHVPYSQAPSGFKYWLKERGASLQHTAPFG<br>CQIATNPVRAMNCAVGNMPISIDIPDAAFTRVVDAPSLTDMSCEVSACTHSSDFGGVAIIKY<br>AASKKGKCAVHSMTNAVTIREAEIEVEGNSQLQISFSTALASAEFRVQVCSTQVHCAAECHP<br>PKDHIVNYPASHTTLGVQDISATAMSWVQKITGGVGLVVAVAALILIVVLCVSFSRHMSIKD<br>HFNVYKATRPYLAHCPDCGEGHSCHSPVALERIRNEATDGTLKIQVSLQIGIKTDDSHDWTK<br>LRYMDNHMPADAERAGLFVRTSAPCTITGTMGHFILARCPKGETLTVGFTDGRKISHSCTHP<br>FHHDPPVIGREKFHSRPQHGRELPCSTYAQSTAATAEEIEVHMPPDTPDRTLMSQQSGNVKI<br>TVNSQTVRYKCNCGDSSEGLTTTDKVINNCKVDQCHAAVTNHKKWQYNSPLVPRNAEFGDRK<br>GKVHIPFPLANVTCRVPKARNPTVTYGKNQVIMLLYPDHPTLLSYRNMGEEPNYQEEWVTHK<br>KEIRLTVPTEGLEVTWGNNEPYKYWPQLSTNGTAHGHPHEIILYYYELYPTMTAVVLSVASF<br>ILLSMVGVAVGMCMCARRRCITPYELTPGATVPFLLSLICCIRTAKAYEHVTVIPNTVGVPY<br>KTLVNRPGYSPMVLEMELLSVTLEPTLSLDYITCEYKTVIPSPYVKCCGTAECKDKSLPDYS<br>CKVFTGVYPFMWGGAYCFCDTENTQLSEAHVEKSESCKTEFASAYRAHTASASAKLRVLYQG<br>NNITVAAYANGDHAVTVKDAKFIVGPMSSAWTPFDNKIVVYKGDVYNMDYPPFGAGRPGQFG<br>DIQSRTPESEDVYANTQLVLQRPSAGTVHVPYSQAPSGFKYWLKERGASLQHTAPFGCQIAT<br>NPVRAMNCAVGNMPISIDIPDAAFTRVVDAPSLTDMSCEVSACTHSSDFGGVAIIKYAASKK<br>GKCAVHSMTNAVTIREAEIEVEGNSQLQISFSTALASAEFRVQVCSTQVHCAAECHPPKDHI<br>VNYPASHTTLGVQDISATAMSWVQKITGGVGLVVAVAALILIVVLCVSFSRH (SEQ ID<br>NO. 39) |
| SQ-031495 SE_chikv-Brazillian-E2-E1_KP164568-69_70 | MSTKDNFNVYKATRPYLAHCPDCGEGHSCHSPVALERIRNEATDGTLKIQVSLQIGIKTDDS<br>HDWTKLRYMDNHTPADAERAGLFVRTSAPCTITGTMGHFILTRCPKGETLTVGFTDSRKISH<br>SCTHPFHHDPPVIGREKFHSRPQHGKELPCSTYVQSTAATTEEIEVHMPPDTPDRTLMSQQS<br>GNVKITVNGQTVRYKCNCGGSNEGLITTDKVINNCKVDQCHAAVTNHKKWQYNSPLVPRNAE<br>LGDRKGKIHIPFPLANVTCRVPKARNPTVTYGKNQVIMLLYPDHPTLLSYRNMGEEPNYQEE<br>WVTHKKEVVLTVPTEGLEVTWGNNEPYKYWPQLSTNGTAHGHPHEIILYYYELYPTMTVVVV<br>SVASFVLLSMVGVAVGMCMCARRRCITPYELTPGATVPFLLSLICCIRTAKAYEHVTVIPNT<br>VGVPYKTLVNRPGYSPMVLEMELLSVTLEPTLSLDYITCEYKTVIPSPYVKCCGTAECKDKN<br>LPDYSCKVFTGVYPFMWGGAYCFCDAENTQLSEAHVEKSESCKTEFASAYRAHTASASAKLR<br>VLYQGNNITVTAYANGDHAVTVKDAKFIVGPMSSAWTPFDNKIVVYKGDVYNMDYPPFGAGR<br>PGQFGDIQSRTPESKDVYANTQLVLQRPAAGTVHVPYSQAPSGFKYWLKERGASLQHTAPFG<br>CQIATNPVRAVNCAVGNMPISIDIPDAAFIRVVDAPSLTDMSCEVPACTHSSDFGGVAIIKY<br>AASKKGKCAVHSMTNAVTIREAEIEVEGNSQLQISFSTALASAEFRVQVCSTQVHCVAECHP<br>PKDHIVNYPASHTTLGVQDISATALSWVQKITGGVGLVVAVAALILIVVLCVSFSRH (SEQ<br>ID NO. 40) |
| SE_chikv-Brazillian-E2_KP164567-71_72 | MSIKDHFNVYKATRPYLAHCPDCGEGHSCHSPVALERIRNEATDGTLKIQVSLQIGIKTDDS<br>HDWTKLRYMDNHMPADAERAGLFVRTSAPCTITGTMGHFILARCPKGETLTVGFTDGRKISH<br>SCTHPFHHDPPVIGREKFHSRPQHGRELPCSTYAQSTAATAEEIEVHMPPDTPDRTLMSQQS<br>GNVKITVNSQTVRYKCNCGDSSEGLTTTDKVINNCKVDQCHAAVTNHKKWQYNSPLVPRNAE<br>FGDRKGKVHIPFPLANVTCRVPKARNPTVTYGKNQVIMLLYPDHPTLLSYRNMGEEPNYQEE<br>WVTHKKEIRLTVPTEGLEVTWGNNEPYKYWPQLSTNGTAHGHPHEIILYYYELYPTMTAVVL<br>SVASFILLSMVGVAVGMCMCARRRCITPYELTPGATVPFLLSLICCIRTAKA (SEQ ID<br>NO. 41) |
| SE_chikv-Brazillian-E2_KP164568-69_70 | MSTKDNFNVYKATRPYLAHCPDCGEGHSCHSPVALERIRNEATDGTLKIQVSLQIGIKTDDS<br>HDWTKLRYMDNHTPADAERAGLFVRTSAPCTITGTMGHFILTRCPKGETLTVGFTDSRKISH<br>SCTHPFHHDPPVIGREKFHSRPQHGKELPCSTYVQSTAATTEEIEVHMPPDTPDRTLMSQQS<br>GNVKITVNGQTVRYKCNCGGSNEGLITTDKVINNCKVDQCHAAVTNHKKWQYNSPLVPRNAE<br>LGDRKGKIHIPFPLANVTCRVPKARNPTVTYGKNQVIMLLYPDHPTLLSYRNMGEEPNYQEE<br>WVTHKKEVVLTVPTEGLEVTWGNNEPYKYWPQLSTNGTAHGHPHEIILYYYELYPTMTVVVV<br>SVASFVLLSMVGVAVGMCMCARRRCITPYELTPGATVPFLLSLICCIRTAKA (SEQ ID<br>NO. 42) |
| SE_CHIKV_C_E3_E2_6K_E1_no Flag or V5 or HA (Strain 37997 Senegal) | MEFIPTQTFYNRRYQPRPWAPRPTIQVIRPRPRPQRQAGQLAQLISAVNKLTMRAVPQQKPR<br>RNRKNKKQRQKKQAPQNDPKQKKQPPQKKPAQKKKKPGRRERMCMKIENDCIFEVKHEGKVM<br>GYACLVGDKVMKPAHVKGTIDNADLAKLAFKRSSKYDLECAQIPVHMKSDASKFTHEKPEGY<br>YNWHHGAVQYSGGRFTIPTGAGKPGDSGRPIFDNKGRVVAIVLGGANEGARTALSVVTWNKD<br>IVTKITPEGAEEWSLALPVLCLLANTTFPCSQPPCTPCCYEKEPESTLRMLEDNVMRPGYYQ<br>LLKASLTCSPHRQRRSTKDNFNVYKATRPYLAHCPDCGEGHSCHSPIALERIRNEATDGTLK<br>IQVSLQIGIKTDDSHDWTKLRYMDSHTPADAERAGLLVRTSAPCTITGTMGHFILARCPKGE<br>TLTVGFTDSRKISHTCTHPFHHEPPVIGRERFHSRPQHGKELPCSTYVQSTAATAEEIEVHM<br>PPDTPDRTLMTQQSGNVKITVNGQTVRYKCNCGGSNEGLTTTDKVINNCKIDQCHAAVTNHK<br>NWQYNSPLVPRNAELGDRKGKIHIPFPLANVTCRVPKARNPTVTYGKNQVTMLLYPDHPTLL<br>SYRNMGQEPNYHEEWVTHKKEVTLTVPTEGLEVTWGNNEPYKYWPQMSTNGTAHGHPHEIIL<br>YYYELYPTMTVVIVSVASFVLLSMVGTAVGMCVCARRRCITPYELTPGATVPFLLSLLCCVR<br>TTKAATYYEAAAYLWNEQQPLFWLQALIPLAALIVLCNCLKLLPCCCKTLAFLAVMSIGAHT<br>VSAYEHVTVIPNTVGVPYKTLVNRPGYSPMVLEMELQSVTLEPTLSLDYITCEYKTVIPSPY<br>VKCCGTAECKDKSLPDYSCKVFTGVYPFMWGGAYCFCDAENTQLSEAHVEKSESCKTEFASA<br>YRAHTASASAKLRVLYQGNNITVAAYANGDHAVTVKDAKFVVGPMSSAWTPFDNKIVVYKGD<br>VYNMDYPPFGAGRPGQFGDIQSRTPESKDVYANTQLVLQRPAAGTVHVPYSQAPSGFKYWLK<br>ERGASLQHTAPFGCQIATNPVRAVNCAVGNIPISIDIPDAAFTRVVDAPSVTDMSCEVPACT<br>HSSDFGGVAIIKYTASKKGKCAVHSMTNAVTIREADVEVEGNSQLQISFSTALASAEFRVQV<br>CSTQVHCAAACHPPKDHIVNYPASHTTLGVQDISTTAMSWVQKITGGVGLIVAVAALILIVV<br>LCVSFSRH (SEQ ID NO. 43) |

TABLE 27-continued

| Antigen identifier | Amino acid sequence |
| --- | --- |
| SE_CHIKV_C_<br>E3_E2_6K_E1_<br>no Flag or V5<br>or HA_DX | MEFIPTQTFYNRRYQPRPWAPRPTIQVIRPRPRPQRQAGQLAQLISAVNKLTMRAVPQQKPR<br>RNRKNKKQRQKKQAPQNDPKQKKQPPQKKPAQKKKKPGRRERMCMKIENDCIFEVKHEGKVM<br>GYACLVGDKVMKPAHVKGTIDNADLAKLAFKRSSKYDLECAQIPVHMKSDASKFTHEKPEGY<br>YNWHHGAVQYSGGRFTIPTGAGKPGDSGRPIFDNKGRVVAIVLGGANEGARTALSVVTWNKD<br>IVTKITPEGAEEWSLALPVLCLLANTTFPCSQPPCTPCCYEKEPESTLRMLEDNVMRPGYYQ<br>LLKASLTCSPHRQRRSTKDNFNVYKATRPYLAHCPDCGEGHSCHSPIALERIRNEATDGTLK<br>IQVSLQIGIKTDDSHDWTKLRYMDSHTPADAERAGLLVRTSAPCTITGTMGHFILARCPKGE<br>TLTVGFTDSRKISHTCTHPFHHEPPVIGRERFHSRPQHGKELPCSTYVQSTAATAEEIEVHM<br>PPDTPDRTLMTQQSGNVKITVNGQTVRYKCNCGGSNEGLTTTDKVINNCKIDQCHAAVTNHK<br>NWQYNSPLVPRNAELGDRKGKIHIPFPLANVTCRVPKARNPTVTYGKNQVTMLLYPDHPTLL<br>SYRNMGQEPNYHEEWVTHKKEVTLTVPTEGLEVTWGNNEPYKYWPQMSTNGTAHGHPHEIIL<br>YYYELYPTMTVVIVSVASFVLLSMVGTAVGMCVCARRRCITPYELTPGATVPFLLSLLCCVR<br>TTKAATYYEAAAYLWNEQQPLFWLQALIPLAALIVLCNCLKLLPCCCKTLAFLAVMSIGAHT<br>VSAYEHVTVIPNTVGVPYKTLVNRPGYSPMVLEMELQSVTLEPTLSLDYITCEYKTVIPSPY<br>VKCCGTAECKDKSLPDYSCKVFTGVYPFMWGGAYCFCDAENTQLSEAHVEKSESCKTEFASA<br>YRAHTASASAKLRVLYQGNNITVAAYANGDHAVTVKDAKFVVGPMSSAWTPFDNKIVVYKGD<br>VYNMDYPPFGAGRPGQFGDIQSRTPESKDVYANTQLVLQRPAAGTVHVPYSQAPSGFKYWLK<br>ERGASLQHTAPFGCQIATNPVRAVNCAVGNIPISIDIPDAAFTRVVDAPSVTDMSCEVPACT<br>HSSDFGGVAIIKYTASKKGKCAVHSMTNAVTIREADVEVEGNSQLQISFSTALASAEFRVQV<br>CSTQVHCAAACHPPKDHIVNYPASHTTLGVQDISTTAMSWVQKITGGVGLIVAVAALILIVV<br>LCVSFSRH (SEQ ID NO. 44) |
| SE_CHIKV_E1_<br>no Flag or V5 | MYEHVTVIPNTVGVPYKTLVNRPGYSPMVLEMELQSVTLEPTLSLDYITCEYKTVIPSPYVK<br>CCGTAECKDKSLPDYSCKVFTGVYPFMWGGAYCFCDAENTQLSEAHVEKSESCKTEFASAYR<br>AHTASASAKLRVLYQGNNITVAAYANGDHAVTVKDAKFVVGPMSSAWTPFDNKIVVYKGDVY<br>NMDYPPFGAGRPGQFGDIQSRTPESKDVYANTQLVLQRPAAGTVHVPYSQAPSGFKYWLKER<br>GASLQHTAPFGCQIATNPVRAVNCAVGNIPISIDIPDAAFTRVVDAPSVTDMSCEVPACTHS<br>SDFGGVAIIKYTASKKGKCAVHSMTNAVTIREADVEVEGNSQLQISFSTALASAEFRVQVCS<br>TQVHCAAACHPPKDHIVNYPASHTTLGVQDISTTAMSWVQKITGGVGLIVAVAALILIVVLC<br>VSFSRH (SEQ ID NO. 45) |
| CHIKV_E2_6K_<br>E1_no Flag or<br>V5 | MSTKDNFNVYKATRPYLAHCPDCGEGHSCHSPIALERIRNEATDGTLKIQVSLQIGIKTDDS<br>HDWTKLRYMDSHTPADAERAGLLVRTSAPCTITGTMGHFILARCPKGETLTVGFTDSRKISH<br>TCTHPFHHEPPVIGRERFHSRPQHGKELPCSTYVQSTAATAEEIEVHMPPDTPDRTLMTQQS<br>GNVKITVNGQTVRYKCNCGGSNEGLTTTDKVINNCKIDQCHAAVTNHKNWQYNSPLVPRNAE<br>LGDRKGKIHIPFPLANVTCRVPKARNPTVTYGKNQVTMLLYPDHPTLLSYRNMGQEPNYHEE<br>WVTHKKEVTLTVPTEGLEVTWGNNEPYKYWPQMSTNGTAHGHPHEIILYYYELYPTMTVVIV<br>SVASFVLLSMVGTAVGMCVCARRRCITPYELTPGATVPFLLSLLCCVRTTKAATYYEAAAYL<br>WNEQQPLEWLQALIPLAALIVLCNCLKLLPCCCKTLAFLAVMSIGAHTVSAYEHVTVIPNTV<br>GVPYKTLVNRPGYSPMVLEMELQSVTLEPTLSLDYITCEYKTVIPSPYVKCCGTAECKDKSL<br>PDYSCKVFTGVYPFMWGGAYCFCDAENTQLSEAHVEKSESCKTEFASAYRAHTASASAKLRV<br>LYQGNNITVAAYANGDHAVTVKDAKFVVGPMSSAWTPFDNKIVVYKGDVYNMDYPPFGAGRP<br>GQFGDIQSRTPESKDVYANTQLVLQRPAAGTVHVPYSQAPSGFKYWLKERGASLQHTAPFGC<br>QIATNPVRAVNCAVGNIPISIDIPDAAFTRVVDAPSVTDMSCEVPACTHSSDFGGVAIIKYT<br>ASKKGKCAVHSMTNAVTIREADVEVEGNSQLQISFSTALASAEFRVQVCSTQVHCAAACHPP<br>KDHIVNYPASHTTLGVQDISTTAMSWVQKITGGVGLIVAVAALILIVVLCVSFSRH (SEQ<br>ID NO. 46) |
| SE_CHIKV_E2_<br>no Flag or<br>V5 | MSTKDNFNVYKATRPYLAHCPDCGEGHSCHSPIALERIRNEATDGTLKIQVSLQIGIKTDDS<br>HDWTKLRYMDSHTPADAERAGLLVRTSAPCTITGTMGHFILARCPKGETLTVGFTDSRKISH<br>TCTHPFHHEPPVIGRERFHSRPQHGKELPCSTYVQSTAATAEEIEVHMPPDTPDRTLMTQQS<br>GNVKITVNGQTVRYKCNCGGSNEGLTTTDKVINNCKIDQCHAAVTNHKNWQYNSPLVPRNAE<br>LGDRKGKIHIPFPLANVTCRVPKARNPTVTYGKNQVTMLLYPDHPTLLSYRNMGQEPNYHEE<br>WVTHKKEVTLTVPTEGLEVTWGNNEPYKYWPQMSTNGTAHGHPHEIILYYYELYPTMTVVIV<br>SVASFVLLSMVGTAVGMCVCARRRCITPYELTPGATVPFLLSLLCCVRTTKA (SEQ ID<br>NO. 47) |

Example 30. ZIKV Vaccines

The design of preferred Zika vaccine mRNA constructs of the invention encode prME proteins from the Zika virus intended to produce significant immunogenicity. The open reading frame comprises a signal peptide (to optimize expression into the endoplasmic reticulum) followed by the Zika prME polyprotein sequence. The particular prME sequence used is from a Micronesian strain (2007) that most closely represents a consensus of contemporary strain prMEs. This construct has 99% prME sequence identity to the current Brazilian isolates.

Within the Zika family, there is a high level of homology within the prME sequence (>90%) across all strains so far isolated (See Table 28 below). The high degree of homology is also preserved when comparing the original isolates from 1947 to the more contemporary strains circulating in Brazil in 2015, suggesting that there is "drift" occurring from the original isolates. Furthermore, attenuated virus preparations have provided cross-immunization to all other strains tested, including Latin American/Asian, and African.

Overall, this data suggests that cross-protection of all Zika strains is possible with a vaccine based on prME.

TABLE 28

| Zika virus prME homology | | | | |
|---|---|---|---|---|
| Zika virus | | | Pairwise AA % identity to Brazilian isolates | |
| Strain | Country of isolation | Year of isolation | prME | Genome |
| South American | Suriname | 2015 | 100.0% | 99.0% |
| Asian | Cambodia | 2010 | 99.4% | 99.1% |
| | French Polynesia | 2013 | 99.7% | 99.4% |
| | Micronesia | 2007 | 98.8% | 97.1% |
| African | Senegal | 2002 | 92.5% | 89.9% |
| | Ugnada | 1947 | 91.0% | 87.3% |

Figure 27:
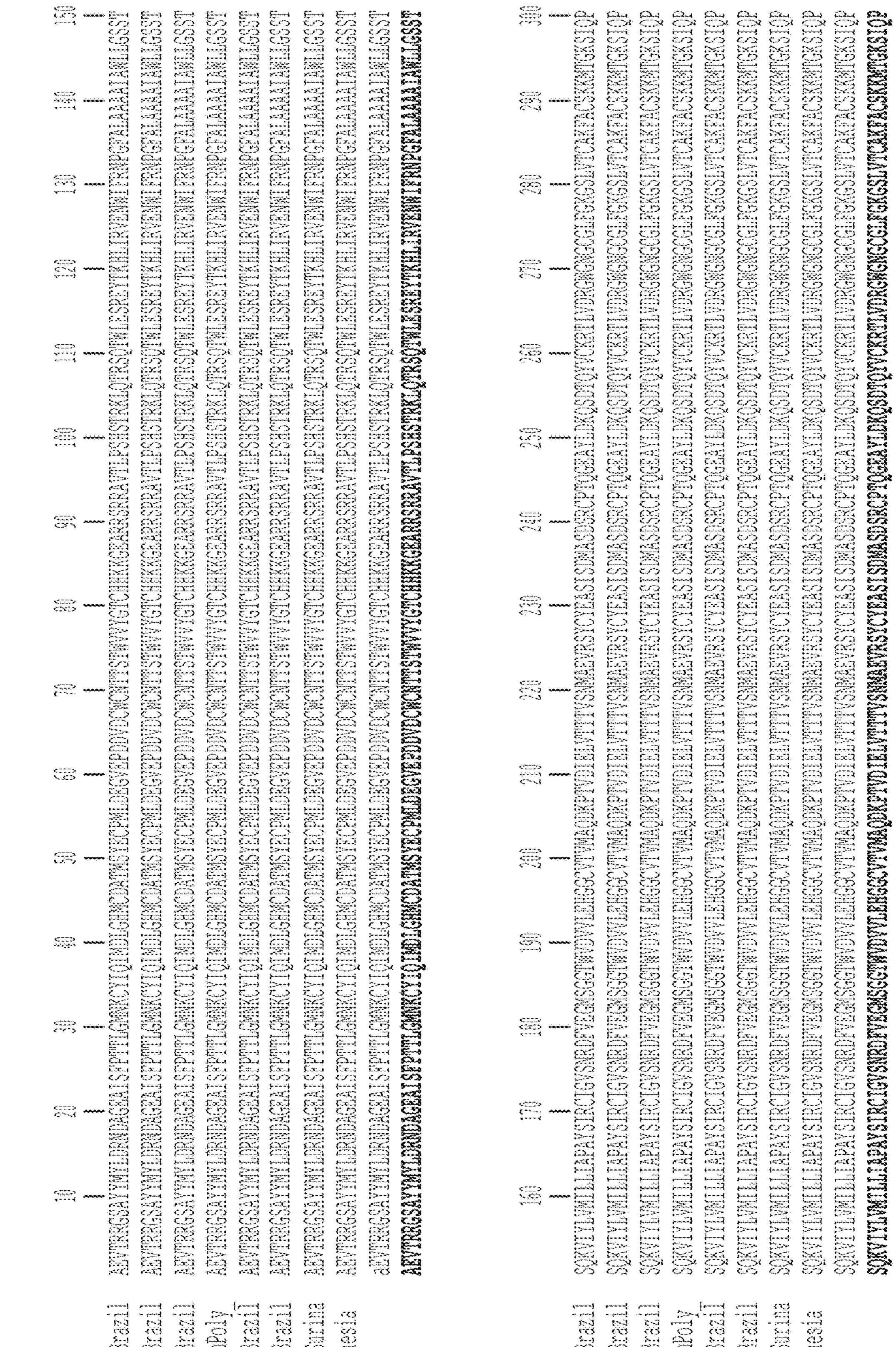
FIG. 27 shows a sequence alignment of currently circulating Zika Virus strains.
Figure 27:
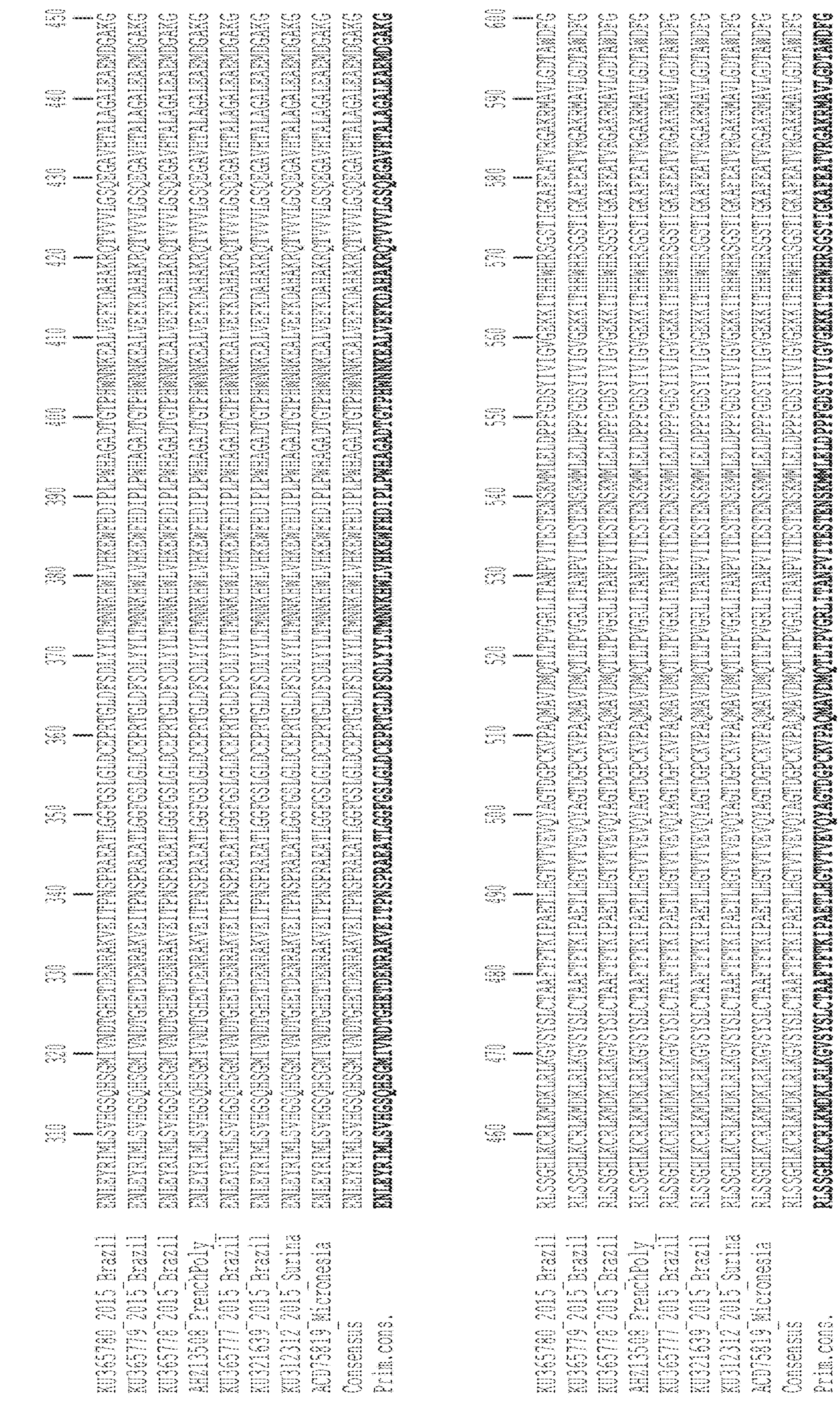

In fact, the prM/M and E proteins of ZIKV have a very high level (99%) of sequence conservation between the currently circulating Asiatic and Brazilian viral strains. The sequence alignment of the prM/M and E proteins is shown in FIG. 27.

The M and E proteins are on the surface of the viral particle. Neutralizing antibodies predominantly bind to the E protein, the preM/M protein functions as a chaperone for proper folding of E protein and prevent premature fusion of E protein within acidic compartments along the cellular secretory pathway.

Figure 26A:
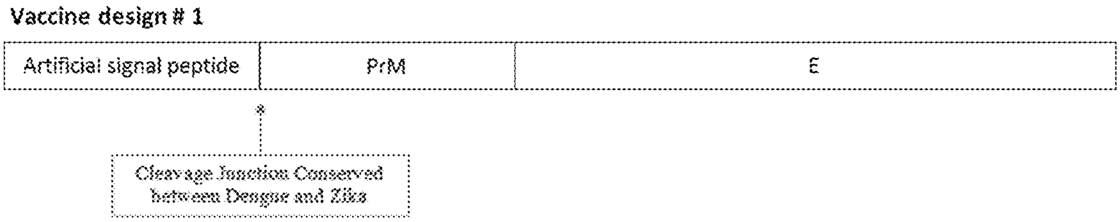
FIG. 26A shows a schematic of a ZIKV vaccine that comprises a RNA polynucleotide encoding a signal peptide fused to Zika prM protein fused to Zika E protein.
Figure 26B:
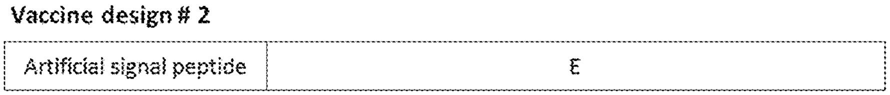
FIG. 26B shows a schematic of a ZIKV vaccine that comprises a RNA polynucleotide encoding a signal peptide fused to Zika E protein. The cleavage junction is located between the signal peptide and the Zika prM protein and is conserved between Dengue and Zika.

Described herein are examples of ZIKV vaccine designs comprising mRNA encoding the both prM/M and E proteins or E protein alone (FIGS. 26A and 26B). FIG. 26A depicts mRNA encoding an artificial signal peptide fused to prM protein fused to E protein. FIG. 2B depicts mRNA encoding an artificial signal peptide fused to E protein.

ZIKV vaccine constructs can encode the prME or E proteins from different strains, for example, Brazil_isolate_ZikaSPH2015 or ACD75819_Micronesia, having a signal peptide fused to the N-termini of the antigenic protein(s). In this example, ZIKV vaccines comprise mRNAs encoding antigenic polypeptides having amino acid sequences of SEQ ID NO: 50-59. The examples are not meant to be limiting.

Figure 28:
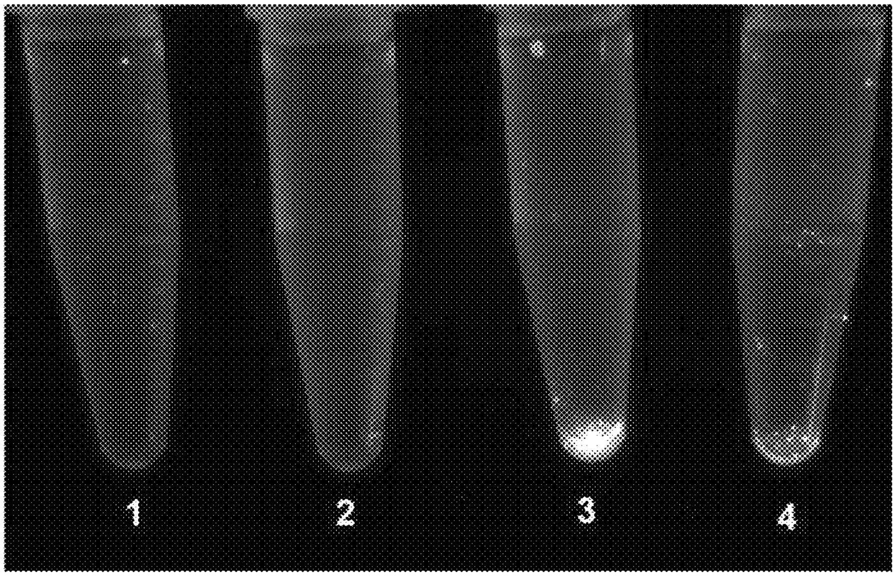
FIG. 28 shows fluorescent staining of non-reduced mammalian cell lysates. Tube 1 contains lysed cell precipitate obtained from 293T cells transfected with ZIKV prME mRNA and stained with secondary antibody only (negative control). Tube 2 contains lysed cell precipitate obtained from untransfected 293T cells and stained with anti-ZIKV human serum (1:20) and goat anti-human Alexa Fluor 647 (negative control). Tube 3 contains lysed cell precipitate obtained from 293T cells transfected with ZIKV prME mRNA and stained with anti-ZIKV human serum (1:20) and goat anti-human Alexa Fluor 647. Tube 4 contains lysed cell precipitate obtained from 293T cells transfected with ZIKV prME mRNA and stained with anti-ZIKV human serum (1:200) and goat anti-human Alexa Fluor 647. The antibodies in anti-ZIKV human serum can detect non-reduced proteins expressed by prME mRNA constructs.

Example 31. Expression of ZIKV prME Protein in Mammalian Cells Using ZIKV mRNA Vaccine Construct The ZIKV prME mRNA vaccine construct were tested in mammalian cells (239T cells) for the expression of ZIKV prME protein. 293T cells were plated in 24-well plates and were transfected with 2 μg of ZIKV prME mRNA using a Lipofectamine transfection reagent. The cells were incubated for the expression of the ZIKV prME proteins before they were lysed in an immunoprecipitation buffer containing protease inhibitor cocktails. Reducing agent was not added to the lysis buffer to ensure that the cellular proteins were in a non-reduced state. Cell lysates were centrifuged at 8,000×g for 20 mins to collect lysed cell precipitate. The cell precipitates were then stained with anti ZIKV human serum and goat anti-human Alexa Fluor 647. Fluorescence was detected as an indication of prME expression (FIG. 28).

Figure 29:
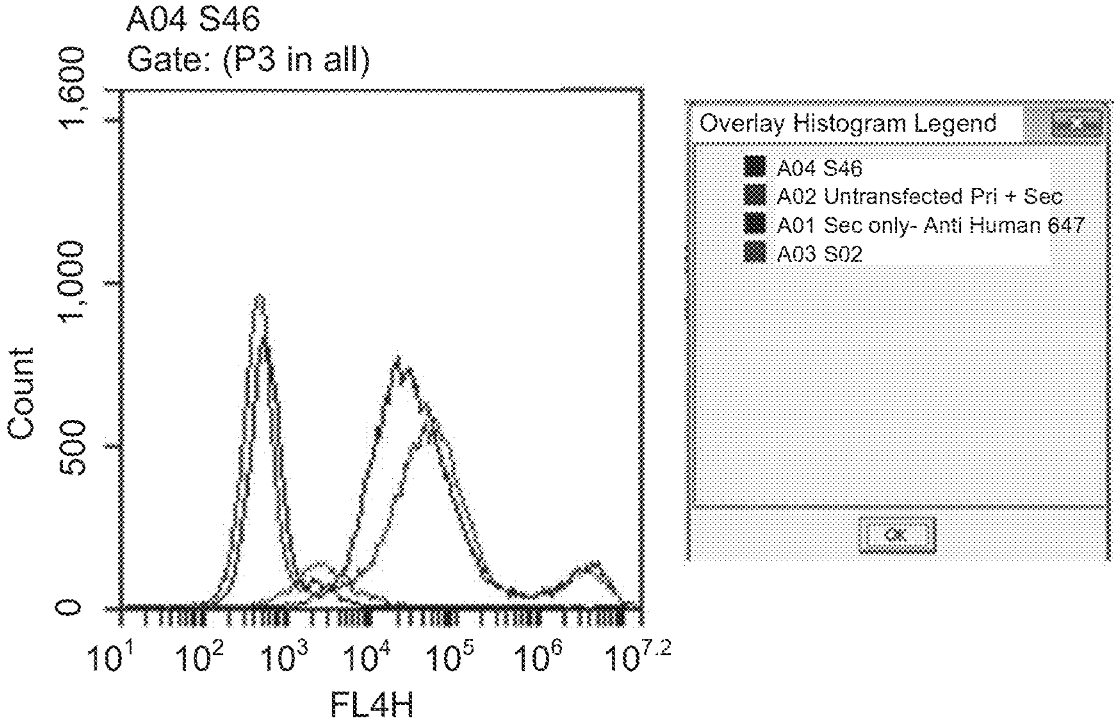
FIG. 29 shows a histogram indicating intracellular detection of ZIKA prME protein using human anti-ZIKV serum.
Figure 30A:
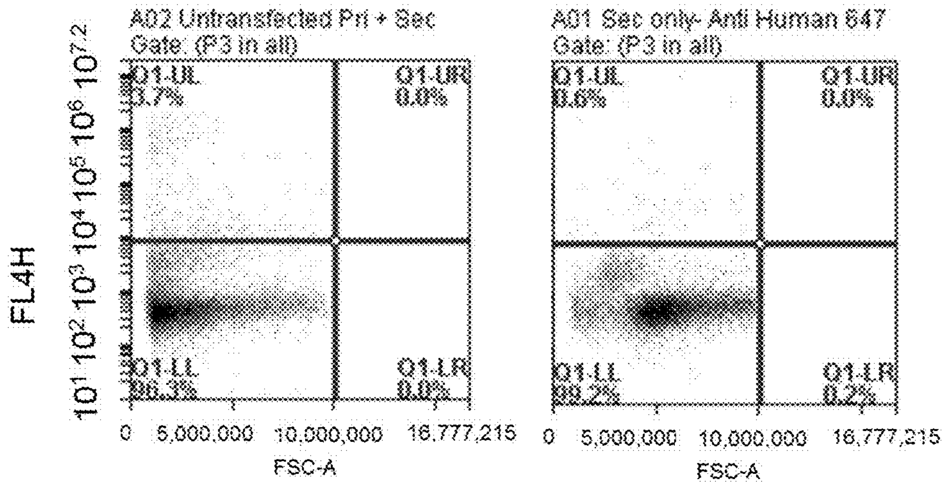
FIGS. 30A-30B show the results of detecting prME protein expression in mammalian cells with fluorescence-activated cell sorting (FACS) using a flow cytometer. Cells expressing prME showed higher fluorescence intensity when stained with anti-ZIKV human serum.
Figure 30B:
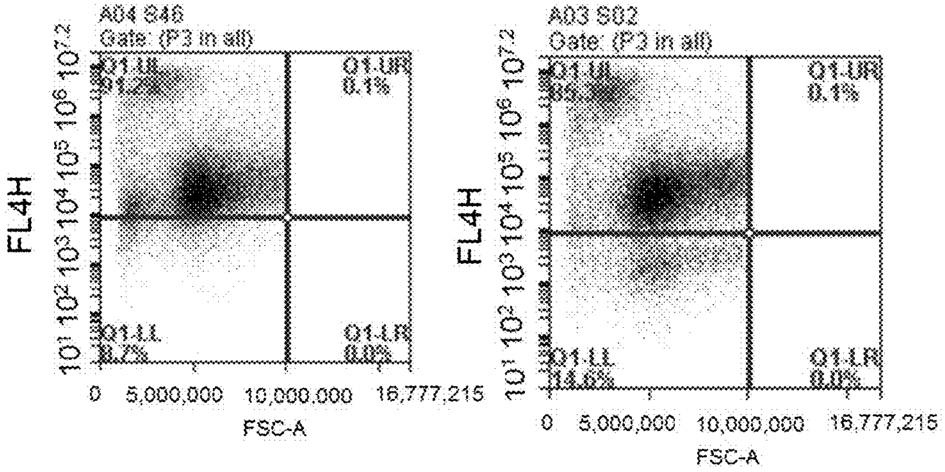
Figure 31:
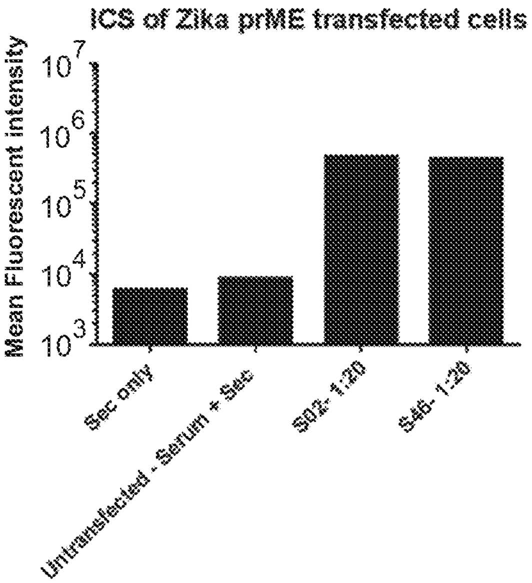
FIG. 31 shows a graph of neutralizing titers from Balb/c mice immunized with ZIKV mRNA vaccine encoding prME.

The expression of ZIKV prME protein was also detected by fluorescence-activated cell sorting (FACS) using a flow cytometer. 293F cells ($2\times10^6$ cells/ml, 30 ml) were transfected with 120 μg PEI, 1 ml of 150 mM NaCl, and 60 μg prME mRNA. Transfected cells were incubated for 48 hours at 37° C. in a shaker at 130 rpm and under 5% $CO_2$. The cells were then washed with PBS buffer containing 2% FBS and fixed in a fixation buffer (PBS buffer containing formalin) for 20 minutes at room temperature. The fixed cells were permeabilized in a permeabilization buffer (PBS+1% Triton X100+1 μl of Golgi plug/ml of cells). The permeabilized cells were then stained with anti-ZIKV human serum (1:20 dilution) and goat anti-human Alexa Fluor 647 secondary antibody, before they were sorted on a flow cytometer. As shown in FIG. 29, FIG. 30A and FIG. 30B, cells transfected with prME mRNA and stained with the anti-ZIKA human serum shifted to higher fluorescent intensity, indicating that prME expressed from the ZIKV mRNA vaccine constructs in the transfected cells.

Example 32. Expression, Purification and Characterization of Zika VLPs

VLPs were made in HeLa cells and in HEK293t cells and purified via PEG precipitation or ultracentrifugation, respectively. Cells were cultured in culture media. Prior to transfection, cells were passaged twice in virus growth media +10% FBS to media adaptation.

Cells were seeded the day before transfection into T-175 flask. 100 ug of prME-encoding mRNA was transfected using 100 μg pf lipofectamine as per manufacturer's protocol. 6 hours post transfection, monolayers were washed twice with 1×PBS and 20 mL of virus growth media was added. Supernatant was collected 24-48 hours post transfection by centrifugation at 2000×g for 10 mins and 0.22 μm filtration.

Figure 32:
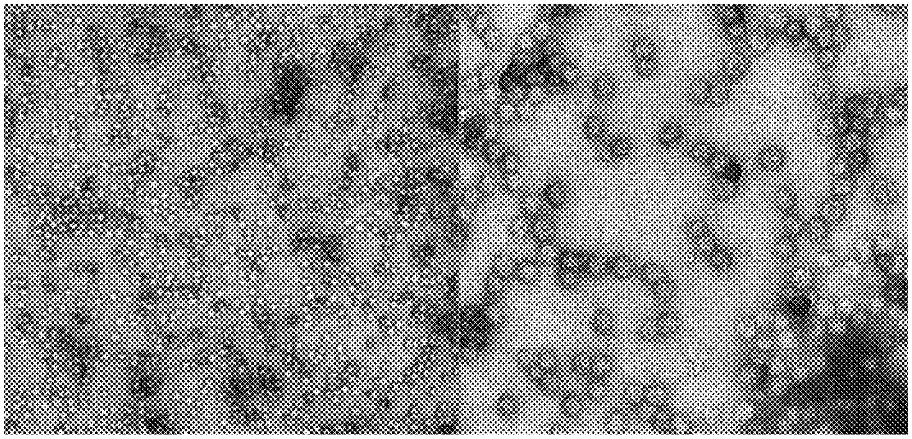
FIG. 32 shows negative stain images for Hela samples.

For VLP purification via PEG precipitation, VLP's were concentrated using Biovision PEG precipitation kit as per manufacturer's protocol. In brief, supernatant with VLP's was mixed with PEG8000 and incubated at 4° C. for 16 hours. After incubation, mixture was centrifuged at 3000×g for 30 mins. Pellet containing concentrated VLP's was collected and suspended into PBS. VLP's were further buffer exchanged into PBS (1:500) using amicon ultra 100MWCO filter. Purified samples were negative stained (FIG. 32).

Expression of prME from the vaccine mRNA constructs on the invention was demonstrated to result in the production of virus like particles (VLPs) that are expected to present to the immune system as identical to Zika virus particles. FIG. 32 shows negative stain electron micrographs of supernatants from HeLa cells transfected with mRNA encoding Zika prME. The virus-like particles (VLPs), purified by PEG precipitation, have highly uniform size (~35-40 nm) and morphology. The bumpy appearance of the VLP surface appears to reflect mostly immature morphology due to expression from HeLa cells, which have very low expression of furin, a host protease that is required for maturation the viral envelope. Upon maturation, these VLPs will have an exterior structure essentially identical to wild type viral particles, thus eliciting a broad immune response to future Zika virus exposure.

Figure 33A:
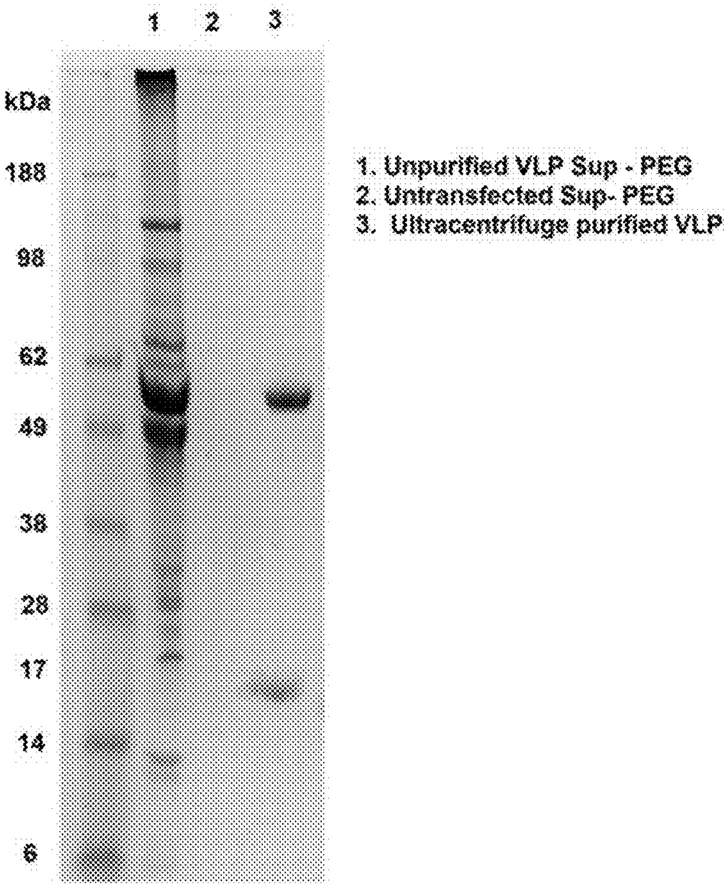
FIG. 33A shows a reducing SDS-PAGE gel of Zika VLP.

For VLP purification via ultracentrifugation, 293T cells were transfected with Zika prME mRNA as described herein. Supernatant was collected 24 hours after changing the media as described herein. (30 hours post transfection) VLP's were concentrated using Biovision PEG virus precipitation kit into 500 μL volume. VLP were further purified using a 10-50% sucrose gradient. Sample layer was seen between 20-30% sucrose layers and collected. VLP's were buffered exchanged into PBS by 1:1000 dilution using a 100MWCO amicon ultra filter. VLP's concentrated after PEG precipitation and ultracentrifuge purified VLP were analyzed on a reducing SDS-PAGE gel for purity (FIG. 33).

Example 33: Immunogenicity Studies

Study A

Figure 33B:
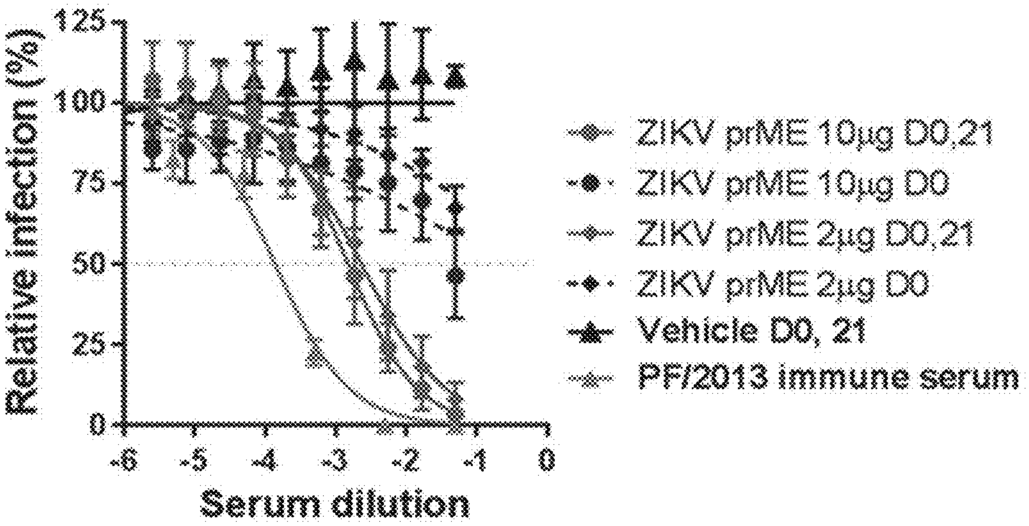
FIG. 33B shows a graph of neutralizing titers obtained from Balb/c mice immunized with a ZIKV mRNA vaccine.

The instant study was designed to test the immunogenicity in Balb/c mice of candidate ZIKV vaccines comprising a mRNA polynucleotide encoding ZIKV prME. Four groups of Balb/c mice (n=5) were immunized intramuscularly (IM) with 10 μg (n=2) or 2 μg (n=2) of the candidate vaccine. One group of mice was administered PBS intramuscularly as a control. All mice were administered an initial dose of vaccine (Groups 1-4) or PBS (Group 5) on Day 0, and then the mice in Groups 1 and 3 were administered a boost dose on Day 21, while the mice in Group 5 were administered PBS on Day 21. All mice were bled on Day 41. See Table 29. Anti-Zika neutralization IgG titer was determined on Day-1, Day 28 and Day 41 (FIG. 33B).

TABLE 29

ZIKV mRNA Vaccine Immunogenicity Study

| Group | Study design BALB/C Vaccine | N | Dose | Route | Immunization Prime | Boost | Endpoint |
|---|---|---|---|---|---|---|---|
| 1 | Zika prME vaccine | 5 | 10 ug | IM | Day 0 | Day 21 | Terminal bleeds on Day 41. Anti Zika neutralizing IgG titer. |
| 2 | Zika prME vaccine | 5 | 10 ug | IM | Day 0 | NA | |
| 3 | Zika prME vaccine | 5 | 2 ug | IM | Day 0 | Day 21 | |
| 4 | Zika prME vaccine | 5 | 2 ug | IM | Day 0 | NA | |
| 5 | PBS | 5 | NA | IM | Day 0 | Day 21 | |

Day 42 neutralizing titers reached EC50s of 427 for 2 μg and 690 for 10 μg. The control serum in this experiment was from naturally infected immunocompromised mice (Ifnar1−/−, derived from B/6 lineage) in which high viral loads would be achieved.

Study B

The instant study is designed to test the immunogenicity in mice of candidate ZIKV vaccines comprising a mRNA polynucleotide encoding ZIKV polyprotein. Mice are immunized intravenously (IV), intramuscularly (IM), or intradermally (ID) with candidate vaccines. Up to three immunizations are given at 3-week intervals (i.e., at weeks 0, 3, 6, and 9), and sera are collected after each immunization until weeks 33-51. Serum antibody titers against ZIKV polyprotein are determined by ELISA.

Example 34: ZIKV Rodent Challenge

Study A

The instant study was designed to test the efficacy in AG129 mice of candidate ZIKV vaccines against a lethal challenge using a ZIKV vaccine comprising mRNA encoding ZIKV prME. Four groups of AG129 mice (n=8) were immunized intramuscularly (IM) with 10 μg (n=2) or 2 μg (n=2) of the candidate vaccine. One group of mice was administered PBS intramuscularly as a control. All mice were administered an initial dose of vaccine (Groups 1-4) or PBS (Group 5) on Day 0, and then the mice in Groups 1 and 3 were administered a boost dose on Day 21, while the mice in Group 5 were administered PBS on Day 21. All mice were challenged with a lethal dose of ZIKV in Day 42. All mice were then monitored for survival and weight loss. Anti-Zika neutralization IgG titer was determined on Day −1, Day 28 and Day 41, and viral load was determined 5 days post challenge.

TABLE 30

ZIKV In vivo challenge

| Group | Study design AG129 Vaccine | n | Dose | Route | Immunization Prime | Boost | Challenge | Endpoint |
|---|---|---|---|---|---|---|---|---|
| 1 | Zika prME vaccine | 8 | 10 ug | IM | Day 0 | Day 21 | Day 42 | Monitor for survival and weight loss. Viral load at Day 5 |
| 2 | Zika prME vaccine | 8 | 10 ug | IM | Day 0 | NA | | |
| 3 | Zika prME vaccine | 8 | 2 ug | IM | Day 0 | Day 21 | | |
| 4 | Zika prME vaccine | 8 | 2 ug | IM | Day 0 | NA | | |
| 5 | PBS | 8 | NA | IM | Day 0 | Day 21 | | |

Study B

The instant study is designed to test the efficacy in AG129 mice of candidate ZIKV vaccines against a lethal challenge using a ZIKV vaccine comprising mRNA encoding ZIKV polyprotein. Animals are challenged with a lethal dose of the ZIKV. Animals are immunized intravenously (IV), intramuscularly (IM), or intradermally (ID) at week 0 and week 3 with candidate ZIKV vaccines with and without adjuvant. The animals are then challenged with a lethal dose of ZIKV on week 7 via IV, IM or ID. Endpoint is day 13 post infection, death or euthanasia. Animals displaying severe illness as determined by >30% weight loss, extreme lethargy or paralysis are euthanized. Body temperature and weight are assessed and recorded daily.

In experiments where a lipid nanoparticle (LNP) formulation is used, the formulation may include a cationic lipid, non-cationic lipid, PEG lipid and structural lipid in the ratios 50:10:1.5:38.5. The cationic lipid is DLin-KC2-DMA or DLin-MC3-DMA (50 mol %), the non-cationic lipid is DSPC (10 mol %), the PEG lipid is PEG-DOMG or PEG-DMG (1.5 mol %) and the structural lipid is cholesterol (38.5 mol %), for example.

TABLE 31

ZIKV Nucleic Acid Sequences

| Description | Sequence | SEQ ID NO: |
|---|---|---|
| Zika virus strain MR 766 polyprotein gene, complete cds GenBank Accession: DQ859059 | ATGAAAAACCCAAAGAAGAAATCCGGAGGATTCCGGATTGTCAATATGCTAAAAC<br>GCGGAGTAGCCCGTGTAAACCCCTTGGGAGGTTTGAAGAGGCTGCCAGCCGGACT<br>TCTGCTGGGTCATGGACCCATCAGAATGGTTTTGGCGATATTAGCCTTTTTGAGA<br>TTCACAGCAATCAAGCCATCACTGGGCCTCATCAACAGATGGGGTACCGTGGGGA<br>AAAAAGAGGCTATGGAAATAATAAAAAAATTTAAGAAAGATCTTGCTGCCATGTT<br>GAGAATAATCAATGCTAGGAAGGAGAGGAAGAGACGTGGCGCAGACACCAGCATC<br>GGAATCGTTGGCCTCCTGTTGACTACAGCCATGGCAGCAGAGATCACTAGACGTG<br>GGAGTGCATACTACATGTACTTGGATAGGAGCGATGCAGGGAAGGCCATTTCTTT<br>CGCTACCACATTGGGGGTGAACAAATGCCATGTGCAGATCATGGACCTCGGGCAC<br>ATGTGTGACGCCACCATGAGCTATGAATGCCCTATGCTGGACGAGGGGGTGGAAC<br>CAGATGACGTCGATTGCTGGTGCAACACGACATCAACTTGGGTTGTGTACGGAAC<br>CTGTCATCATAAAAAAGGTGAAGCACGGCGATCTAGAAGAGCCGTCACGCTCCCA<br>TCTCACTCCACAAGGAAATTGCAAACGCGGTCGCAGACTTGGCTAGAATCAAGAG<br>AATACACAAAGCACCTGATCAAGGTTGAAAATTGGATATTCAGGAACCCTGGTTT<br>TACGCTAGTGGCTGTCGCCATCGCCTGGCTTTTGGGAAGCTCGACGAGCCAAAAA<br>GTCATATACTTGGTCATGATACTGCTGATTGCCCCGGCATACAGTATCAGGTGCA<br>TAGGAGTCAGCAATAGAGACTTCGTGGAGGGCATGTCAGGTGGGACCTGGGTTGA<br>CGTTGTCCTGGAACATGGAGGCTGCGTCACCGTGATGGCACAGGACAAGCCAACA<br>GTTGACATAGAGCTGGTCACAACAACGGTTAGTAACATGGCCGAGGTGAGATCCT<br>ATTGTTACGAGGCATCAATATCGGACATGGCTTCGGACAGTCGCTGCCCAACACA<br>AGGTGAAGCCTACCTTGACAAGCAATCAGACACTCAATATGTTTGCAAAAGAACA<br>TTGGTGGACAGAGGTTGGGGAAATGGGTGTGGACTCTTTGGCAAAGGGAGTTTGG<br>TGACATGTGCTAAGTTCACGTGCTCCAAGAAGATGACTGGGAAGAGCATTCAGCC<br>GGAGAACCTGGAGTATCGGATAATGCTATCAGTGCATGGCTCCCAGCACAGTGGG<br>ATGATTGTTAATGATGAAAACAGAGCGAAGGTCGAGGTTACGCCCAATTCACCAA<br>GAGCAGAAGCAACCCTGGGAGGCTTTGGAAGCTTAGGACTTGATTGTGAACCAAG<br>GACAGGCCTTGACTTTTCAGATCTGTATTACCTAACCATGAATAACAAGCATTGG<br>TTGGTGCACAAAGAGTGGTTTCATGACATCCCATTGCCCTGGCATGCTGGGGCAG<br>ACACTGGAACTCCACATTGGAACAACAAGGAGGCATTAGTGGAATTCAAGGACGC<br>CCACGCCAAGAGGCAAACCGTCGTGGTTTTGGGGAGCCAGGAAGGAGCCGTCCAC<br>ACGGCTCTTGCTGGAGCTCTAGAGGCTGAGATGGATGGTGCAAAGGGAAGGCTAT<br>TCTCTGGCCACTTGAAATGTCGCTTAAAAATGGACAAGCTTAGATTGAAGGGCGT<br>GTCATATTCCTTGTGCACCGCGGCATTCACATTCACCAAGGTCCCGGCTGAAACA<br>CTACATGGAACAGTCACAGTGGAGGTGCAGTATGCAGGGACAGATGGACCCTGCA<br>AGGTCCCAGCCCAGATGGCGGTGGACATGCAGACCTTGACCCCAGTCGGAAGGCT<br>GATAACCGCCAACCCCGTGATTACTGAAAGCACTGAGAATTCAAAGATGATGTTG<br>GAGCTCGACCCACCATTTGGGGATTCTTACATTGTCATAGGAGTTGGGGATAAGA<br>AAATCACCCATCACTGGCATAGGAGTGGCAGCACCATTGGAAAAGCATTTGAAGC<br>CACTGTGAGAGGCGCTAAGAGAATGGCAGTCCTGGGGGACACAGCTTGGGACTTT<br>GGATCAGTCGGAGGTGTGTTTAACTCATTGGGCAAGGGCATTCATCAGATTTTTG<br>GAGCAGCTTTCAAATCACTGTTTGGAGGAATGTCCTGGTTCTCACAGATCCTCAT<br>AGGCACTCTGCTGGTGTGGTTAGGTCTGAACACAAAGAATGGGTCTATCTCCCTC<br>ACATGCTTAGCCCTGGGGGGAGTGATGATCTTCCTCTCCACGGCTGTTTCTGCTG<br>ACGTGGGGTGCTCGGTGGACTTCTCAAAAAAAGAAACGAGATGTGGCACGGGGGT<br>GTTCGTCTACAATGACGTTGAAGCCTGGAGGGACCGGTACAAGTACCATCCTGAC<br>TCCCCTCGTAGACTGGCAGCAGCCGTTAAGCAAGCTTGGGAAGAGGGGATTTGTG<br>GGATCTCCTCTGTTTCTAGAATGGAAAACATAATGTGGAAATCAGTGGAAGGAGA<br>GCTCAATGCAATCCTAGAGGAGAATGGAGTCCAACTGACAGTTGTTGTGGGATCT<br>GTAAAAAACCCCATGTGGAGAGGCCCACAAAGATTGCCAGTGCCTGTGAATGAGC<br>TGCCCCATGGCTGGAAAGCCTGGGGGAAATCGTACTTTGTTAGGGCGGCAAAGAC<br>CAACAACAGTTTTGTTGTCGACGGTGACACATTGAAGGAATGTCCGCTCAAGCAC<br>AGAGCATGGAACAGCTTCCTCGTGGAGGATCACGGGTTTGGGGTCTTCCACACCA<br>GTGTTTGGCTTAAGGTTAGAGAAGATTACTCACTGGAGTGTGACCCAGCCGTCAT<br>AGGAACAGCTGTTAAGGGAAAGGAGGCCGCGCACAGTGATCTAGGCTATTGGATT<br>GAAAGTGAAAAGAATGACACATGGAGGCTGAAGAGGGCTCATTTGATTGAGATGA<br>AAACATGTGAGTGGCCAAAGTCTCACACACTGTGGACAGATGGAGTGGAAGAAAG<br>TGATCTGATCATACCCAAGTCTTTAGCTGGTCCACTCAGCCACCACAACACCAGA<br>GAGGGTTACAGAACTCAAGTGAAAGGGCCATGGCATAGTGAGGAGCTTGAAATCC<br>GATTTGAGGAATGTCCAGGTACCAAGGTTCATGTGGAGGAGACATGCGGAACGAG<br>AGGACCATCTCTGAGATCAACCACTGCAAGCGGAAGGGTCATTGAGGAATGGTGC<br>TGTAGGGAATGCACAATGCCCCCACTATCGTTCCGAGCAAAAGATGGCTGCTGGT<br>ATGGAATGGAGATAAGGCCTAGGAAAGAACCAGAGAGCAACTTAGTGAGGTCAAT<br>GGTGACAGCGGGATCAACCGATCATATGGATCATTTTTCTCTTGGAGTGCTTGTG<br>ATTCTACTCATGGTGCAGGAAGGGTTGAAGAAGAGAATGACCACAAAGATCATCA<br>TGAGCACATCAATGGCAGTGCTGGTGGCCATGATCTTGGGAGGATTCTCAATGAG<br>TGACCTGGCTAAGCTTGTGATCCTGATGGGGGCCACTTTCGCAGAAATGAACACT<br>GGAGGAGACGTAGCTCACTTGGCATTAGTAGCGGCATTTAAAGTCAGACCAGCCT<br>TGCTGGTCTCATTTATCTTCAGAGCCAACTGGACACCTCGTGAGAGCATGCTGCT<br>AGCCTTGGCTTCGTGTCTTCTGCAAACTGCGATCTCCGCTCTTGAAGGCGACTTG<br>ATGGTCCTCGTTAATGGATTTGCTTTGGCCTGGTTGGCAATACGTGCAATGGCCG<br>TGCCACGCACTGACAACATCGCTCTAGCAATTCTGGCTGCTCTAACACCACTAGC<br>CCGAGGCACACTGCTCGTGGCATGGAGAGCGGGCCTCGCCACTTGTGGAGGGTTC<br>ATGCTCCTCTCCCTGAAAGGGAAAGGTAGTGTGAAGAAGAACCTGCCATTCGTCG<br>CGGCCTTGGGATTGACCGCTGTGAGAATAGTGGACCCCATTAATGTGGTGGGACT | 48 |

TABLE 31-continued

ZIKV Nucleic Acid Sequences

| Description | Sequence | SEQ ID NO: |
|---|---|---|
| | ACTGTTACTCACAAGGAGTGGGAAGCGGAGCTGGCCCCCTAGTGAAGTGCTCACT | |
| | GCTGTCGGCCTGATATGTGCATTGGCCGGAGGGTTTGCCAAGGCAGACATAGAGA | |
| | TGGCTGGGCCCATGGCGGCAGTGGGCCTGCTAATTGTCAGTTATGTGGTCTCGGG | |
| | AAAGAGTGTAGATATGTACATTGAAAGAGCAGGTGACATCACATGGGAGAAAGAC | |
| | GCGGAAGTCACTGGAAACAGTCCTCGGCTTGACGTGGCACTAGATGAGAGTGGTG | |
| | ATTTCTCTCTGGTGGAGGAAGATGGTCCACCCATGAGAGAGATCATACTTAAGGT | |
| | GGTCTTGATGGCCATCTGTGGCATGAACCCAATAGCCATACCTTTTGCTGCAGGA | |
| | GCGTGGTATGTGTATGTGAAGACTGGGAAAAGGAGTGGTGCCCTCTGGGACGTGC | |
| | CTGCTCCGAAAGAAGTGAAAAAAGGAGAGACCACAGATGGAGTGTACAGAGTGAT | |
| | GACTCGCAGACTGCTGGGTTCAACACAAGTTGGAGTGGGAGTCATGCAGGAGGGA | |
| | GTCTTCCACACCATGTGGCACGTCACAAAAGGGGCCGCATTGAGGAGCGGTGAAG | |
| | GGAGACTTGATCCATACTGGGGGGATGTCAAGCAGGACTTGGTGTCATATTGTGG | |
| | GCCTTGGAAGCTGGACGCAGCTTGGGACGGAGTTAGTGAGGTGCAGCTTCTGGCC | |
| | GTACCCCCTGGAGAGAGAGCCAGAAACATTCAGACTCTGCCTGGAATATTTAAGA | |
| | CAAAGGATGGGGACATCGGAGCAGTTGCTTTGGACTATCCTGCAGGAACCTCAGG | |
| | ATCTCCGATCCTAGACAAATGCGGGAGAGTGATAGGACTCTATGGCAATGGGGTT | |
| | GTGATCAAGAACGGAAGCTATGTTAGTGCTATAACCCAGGGAAAGAGGGAGGAGG | |
| | AGACTCCGGTTGAGTGTTTTGAACCCTCGATGCTGAAGAAGAAGCAGCTAACTGT | |
| | CCTGGACCTGCATCCAGGGGCTGGGAAAACCAGGAGAGTTCTTCCTGAAATAGTC | |
| | CGTGAAGCTATAAAGAAGAGACTCCGCACGGTGATCTTGGCACCAACCAGGGTCG | |
| | TCGCTGCTGAGATGGAGGAAGCCCTGAGAGGACTTCCGGTGCGTTACATGACAAC | |
| | AGCAGTCAAGGTCACCCATTCTGGGACAGAAATCGTTGATTTGATGTGCCATGCC | |
| | ACCTTCACTTCACGCCTACTACAACCCATTAGAGTCCCTAATTACAACCTCTACA | |
| | TCATGGATGAAGCCCATTTCACAGACCCCTCAAGCATAGCTGCAAGAGGATATAT | |
| | ATCAACAAGGGTTGAGATGGGCGAGGCAGCAGCCATCTTTATGACTGCCACACCA | |
| | CCAGGAACCCGCGATGCGTTTCCAGATTCCAACTCACCAATCATGGACACAGAAG | |
| | TGGAAGTCCCAGAGAGAGCCTGGAGCTCAGGCTTTGATTGGGTGACGGACCATTC | |
| | TGGGAAAACAGTTTGGTTCGTTCCAAGCGTGAGGAATGGAAATGAAATCGCAGCC | |
| | TGTCTGACAAAGGCTGGAAAGCGGGTTATACAGCTTAGTAGGAAAACTTTTGAGA | |
| | CAGAGTTTCAGAAAACAAAAAATCAAGAGTGGGACTTTGTCATAACAACTGACAT | |
| | CTCAGAGATGGGTGCCAACTTCAAGGCTGACCGGGTTATAGATTCCAGGAGATGC | |
| | CTAAAGCCAGTTATACTTGATGGTGAGAGAGTCATCTTGGCTGGGCCCATGCCTG | |
| | TCACGCATGCTAGCGCTGCTCAGAGGAGAGGACGTATAGGCAGGAACCCCAACAA | |
| | GCCTGGAGATGAGTACATGTATGGAGGTGGGTGTGCGGAGACTGATGAAGACCAT | |
| | GCACATTGGCTTGAAGCAAGAATGCTTCTTGACAACATTTACCTCCAGGATGGCC | |
| | TCATAGCCTCGCTCTATCGACCTGAGGCCGACAAGGTAGCCGCCATTGAGGGAGA | |
| | GTTTAAGCTGAGGACAGAGCAAAGGAAGACCTTTGTGGAACTCATGAAGAGAGGA | |
| | GATCTTCCCGTTTGGTTGGCCTACCAGGTTGCATCTGCCGGAATAACTTATACAG | |
| | ACAGAAGATGGTGTTTTGATGGCACAACCAACAACACCATAATGGAAGACAGTGT | |
| | ACCAGCAGAGGTGTGGACCAAGTATGGAGAGAAGAGAGTGCTCAAACCAAGATGG | |
| | ATGGACGCCAGGGTCTGCTCAGATCATGCGGCCCTGAAGTCGTTCAAAGAATTCG | |
| | CCGCTGGGAAAAGAGGAGCGGCTTTGGGAGTAATGGAGGCCCTGGGAACATTACC | |
| | AGGACACATGACAGAGAGGTTTCAGGAAGCCATTGATAACCTCGCTGTGCTCATG | |
| | CGAGCAGAGACTGGAAGCAGGCCCTACAAGGCAGCGGCAGCCCAATTGCCGGAGA | |
| | CCCTAGAGACCATCATGCTTTTAGGCCTGCTGGGAACAGTATCGCTGGGGATCTT | |
| | TTTTGTCTTGATGAGGAACAAGGGCATCGGGAAGATGGGCTTTGAAATGGTAACC | |
| | CTTGGGGCCAGCGCATGGCTCATGTGGCTCTCAGAAATCGAACCAGCCAGAATTG | |
| | CATGTGTCCTTATTGTTGTGTTTTTATTACTGGTGGTGCTAATACCAGAGCCAGA | |
| | GAAGCAAAGATCCCCCCAGGACAATCAGATGGCAATCATTATTATGGTGGCAGTG | |
| | GGCCTTTTGGGGTTGATAACTGCAAATGAACTTGGATGGCTGGAGAGAACAAAAA | |
| | ATGACATAGCTCATCTGATGGGAAAGAGAGAAGAGGGAACAACCGTGGGATTCTC | |
| | AATGGACATCGATCTGCGACCAGCCTCCGCATGGGCTATTTATGCCGCATTGACA | |
| | ACCCTCATCACCCCAGCCGTCCAGCACGCGGTAACTACCTCGTACAACAACTACT | |
| | CCTTAATGGCGATGGCCACACAAGCTGGAGTGCTGTTTGGCATGGGCAAAGGGAT | |
| | GCCATTTTATGCATGGGACTTAGGAGTCCCGTTGCTAATGATGGGCTGCTACTCA | |
| | CAACTAACACCCCTGACCCTGATAGTAGCCATCATTTTGCTTGTGGCACATTACA | |
| | TGTACTTGATCCCAGGCCTACAGGCAGCAGCAGCACGCGCTGCCCAGAAGAGAAC | |
| | AGCAGCCGGCATCATGAAGAATCCCGTTGTGGATGGAATAGTGGTAACTGACATT | |
| | GACACAATGACAATTGACCCCCAAGTGGAGAAGAAGATGGGACAAGTGCTACTTA | |
| | TAGCAGTGGCTGTCTCCAGTGCTGTGTTGCTGCGGACCGCTTGGGGATGGGGGA | |
| | GGCTGGAGCTTTGATCACAGCAGCAACTTCCACCCTGTGGGAAGGCTCCCCAAAC | |
| | AAATACTGGAACTCCTCCACAGCCACCTCACTGTGCAACATCTTCAGAGGAAGTT | |
| | ACTTGGCAGGAGCTTCCCTTATTTACACAGTGACAAGAAATGCCGGCCTGGTTAA | |
| | GAGACGTGGAGGTGGAACGGGAGAAACTCTGGGAGAGAAGTGGAAAGCCCGCCTG | |
| | AATCAGATGTCGGCCTTGGAGTTCTACTCTTACAAAAAGTCAGGCATCACTGAAG | |
| | TATGTAGAGAGGAGGCTCGCCGCGCCCTCAAGGATGGAGTGGCCACAGGAGGACA | |
| | TGCTGTATCCCGAGGAAGCGCAAAACTCAGATGGTTGGTGGAGAGAGGATATCTG | |
| | CAGCCCTATGGAAAGGTTGTTGATCTCGGATGCGGCAGAGGGGGCTGGAGTTATT | |
| | ATGCCGCCACCATCCGCAAAGTGCAGGAGGTGAGAGGATACACAAAGGGAGGTCC | |
| | CGGTCATGAAGAGCCCATGCTGGTGCAAAGCTATGGGTGGAACATAATTCGTCTC | |
| | AAGAGTGGAGTGGACGTCTTCCACATGGCGGCTGAGTCGTGTGACACTTTGCTGT | |
| | GTGACATAGGTGAGTCATCATCCAGTCCTGAAGTGGAGGAGACGCGAACACTCAG | |
| | AGTGCTCTCCATGGTGGGGGACTGGCTTGAGAAGAGACCAGGGGCCTTCTGCATA | |
| | AAGGTGTTATGCCCATACACCAGCACCATGATGGAGACCATGGAGCGACTGCAAC | |

TABLE 31-continued

ZIKV Nucleic Acid Sequences

| Description | Sequence | SEQ ID NO: |
|---|---|---|
| | GTAGGTATGGGGGAGGACTAGTCAGAGTGCCACTGTCCCGCAATTCTACACATGA<br>GATGTATTGGGTCTCTGGAGCAAAAAGTAACATCATAAAAAGTGTGTCCACCACA<br>AGTCAGCTCCTCCTGGGACGCATGGATGGGCCCAGGAGGCCAGTGAAGTATGAGG<br>AGGATGTGAACCTCGGCTCAGGCACACGAGCTGTGGCAAGCTGTGCTGAGGCTCC<br>CAACATGAAGGTCATTGGTAGGCGCATTGAGAGAATCCGTAGTGAACATGCAGAA<br>ACATGGTTCTTTGATGAAAACCATCCATACAGGACATGGGCCTACCACGGGAGCT<br>ACGAAGCCCCCACGCAAGGGTCAGCATCTTCCCTCGTGAATGGGGTTGTTAGACT<br>CCTGTCAAAGCCCTGGGATGTGGTGACTGGAGTTACAGGAATAGCTATGACTGAC<br>ACCACACCGTACGGCCAACAAAGAGTCTTCAAAGAAAAAGTGGACACCAGGGTGC<br>CAGACCCTCAAGAAGGTACTCGCCAGGTAATGAACATGGTCGCTTCCTGGCTGTG<br>GAAGGAGCTGGGAAAACGTAAGCGGCCACGTGTCTGCACCAAAGAAGAGTTCATC<br>AACAAGGTGCGCAGCAATGCAGCACTGGGAGCAATATTTGAAGAGGAAAAAGAAT<br>GGAAGACGGCTGTGGAAGCTGTGAATGATCCAAGGTTTTGGGCCCTAGTGGATAA<br>GGAAAGAGAACACCACCTGAGAGGAGAGTGCCATAGTTGTGTGTACAACATGATG<br>GGAAAAAGAGAAAAGAAGCAAGGGGAATTCGGGAAAGCAAAAGGCAGTCGCGCCA<br>TCTGGTACATGTGGTTGGGAGCCAGATTCTTGGAGTTTGAAGCCCTTGGATTCTT<br>GAACGAGGACCATTGGATGGGAAGAGAAAACTCAGGAGGTGGTGTCGAAGGGTTG<br>GGACTGCAAAGACTTGGATACGTTCTAGAAGAAATGAGCCGGGCACCAGGAGGAA<br>AGATGTATGCAGATGACACCGCTGGCTGGGACACCCGCATTAGCAAGTTTGATTT<br>GGAGAATGAAGCCTTGATTACTAACCAAATGGATGAAGGGCACAGAACTCTGGCG<br>TTGGCCGTGATTAAGTACACATACCAAAACAAAGTGGTGAAGGTCCTCAGACCAG<br>CTGAAGGAGGAAAAACAGTCATGGACATCATTTCAAGACAAGACCAGAGGGGGAG<br>CGGACAAGTTGTCACTTATGCTCTCAACACATTTACCAACTTGGTGGTGCAGCTC<br>ATCCGGAACATGGAGGCTGAGGAAGTGTTAGAGATGCAAGACTTATGGCTGTTGA<br>GGAAGCCAGAGAAAGTAACCAGATGGCTGCAGAGTAGCGGATGGGACAGACTCAA<br>ACGAATGGCAGTCAGTGGTGATGACTGTGTTGTAAAGCCAATTGATGACAGGTTT<br>GCACACGCCCTCAGGTTCTTGAATGATATGGGGAAAGTTAGGAAAGACACACAGG<br>AATGGAAACCCTCAACTGGATGGAGCAACTGGGAAGAAGTCCCGTTCTGCTCCCA<br>CCACTTTAACAAGCTGCACCTCAAAGACGGGAGATCCATTGTGGTCCCTTGCCGC<br>CACCAAGATGAACTGATTGGCCGGGCTCGCGTTTCGCCGGGGGCAGGATGGAGCA<br>TCCGGGAGACTGCCTGTCTTGCAAAATCATATGCACAGATGTGGCAGCTTCTTTA<br>TTTCCACAGAAGAGACCTCCGACTGATGGCCAATGCCATTTGCTCGGCCGTGCCA<br>GTTGACTGGGTCCCAACTGGGAGAACTACCTGGTCAATCCATGGAAAGGGAGAAT<br>GGATGACTACTGAGGACATGCTCATGGTGTGGAATAGAGTGTGGATTGAGGAGAA<br>TGATCACATGGAGGACAAGACCCCTGTAACAAAATGGACAGACATTCCCTATTTG<br>GGAAAAAGGGAGGACTTATGGTGTGGATCCCTTATAGGACACAGACCTCGCACCA<br>CTTGGGCTGAGAACATCAAAGACACAGTCAGCATGGTGCGCAGAATCATAGGTGA<br>TGAAGAAAAGTACATGGACTACCTATCCACTCAAGTTCGCTACTTGGGTGAGGAA<br>GGGTCTACACCTGGAGTGCTGTAA | |
| IgE HC signal peptide_prM-E #1 (Brazil_ isolate_ ZikaSPH2015, Sequence, NT (5' UTR, ORF, 3' UTR) | TCAAGCTTTTGGACCCTCGTACAGAAGCTAATACGACTCACTATAGGGAAATAAG<br>AGAGAAAAGAAGAGTAAGAAGAAATATAAGAGCCACCATGGACTGGACCTGGATC<br>CTGTTCCTGGTGGCCGCTGCCACAAGAGTGCACAGCGTGGAAGTGACCAGACGGG<br>GCAGCGCCTACTACATGTACCTGGACAGAAGCGACGCCGGCGAGGCCATCAGCTT<br>TCCAACCACCCTGGGCATGAACAAGTGCTACATCCAGATCATGGACCTGGGCCAC<br>ATGTGCGACGCCACCATGAGCTACGAGTGCCCCATGCTGGACGAGGGCGTGGAAC<br>CCGACGATGTGGACTGCTGGTGCAACACCACCAGCACCTGGGTGGTGTACGGCAC<br>CTGTCACCACAAGAAGGGCGAAGCCAGACGGTCCAGACGGGCCGTGACACTGCCT<br>AGCCACAGCACCAGAAAGCTGCAGACCCGGTCCCAGACCTGGCTGGAAAGCAGAG<br>AGTACACCAAGCACCTGATCCGGGTGGAAAACTGGATCTTCCGGAACCCCGGCTT<br>TGCCCTGGCTGCCGCTGCTATTGCTTGGCTGCTGGGCAGCAGCACCTCCCAGAAA<br>GTGATCTACCTCGTGATGATCCTGCTGATCGCCCCTGCCTACAGCATCCGGTGTA<br>TCGGCGTGTCCAACCGGGACTTCGTGGAAGGCATGAGCGGCGGCACATGGGTGGA<br>CGTGGTGCTGGAACATGGCGGCTGCGTGACAGTGATGGCCCAGGATAAGCCCGCC<br>GTGGACATCGAGCTCGTGACCACCACCGTGTCCAATATGGCCGAAGTGCGGAGCT<br>ACTGCTACGAGGCCAGCATCAGCGACATGGCCAGCGACAGCAGATGCCCTACACA<br>GGGCGAGGCCTACCTGGATAAGCAGTCCGACACCCAGTACGTGTGCAAGCGGACC<br>CTGGTGGATAGAGGCTGGGGCAATGGCTGCGGCCTGTTTGGCAAGGGCAGCCTCG<br>TGACCTGCGCCAAGTTCGCCTGCAGCAAGAAGATGACCGGCAAGAGCATCCAGCC<br>CGAGAACCTGGAATACCGGATCATGCTGAGCGTGCACGGCTCCCAGCACAGCGGC<br>ATGATCGTGAACGACACCGGCCACGAGACAGACGAGAACCGGGCCAAGGTGGAAA<br>TCACCCCCAACAGCCCTAGAGCCGAGGCCACACTGGGCGGCTTTGGATCTCTGGG<br>CCTGGACTGCGAGCCTAGAACCGGCCTGGATTTCAGCGACCTGTACTACCTGACC<br>ATGAACAACAAGCACTGGCTGGTGCACAAAGAGTGGTTCCACGACATCCCCCTGC<br>CCTGGCATGCTGGCGCTGATACAGGCACCCCCCACTGGAACAACAAAGAGGCTCT<br>GGTGGAATTCAAGGACGCCCACGCCAAGCGGCAGACCGTGGTGGTGCTGGGATCT<br>CAGGAAGGCGCCGTGCATACAGCTCTGGCTGGCGCCCTGGAAGCCGAAATGGATG<br>GCGCCAAAGGCAGACTGTCCTCCGGCCACCTGAAGTGCCGGCTGAAGATGGACAA<br>GCTGCGGCTGAAGGGCGTGTCCTACAGCCTGTGTACCGCCGCCTTCACCTTCACC<br>AAGATCCCCGCCGAGACACTGCACGGCACCGTGACTGTGGAAGTGCAGTACGCCG<br>GCACCGACGGCCCTTGTAAAGTGCCTGCTCAGATGGCCGTGGATATGCAGACCCT<br>GACCCCCGTGGGCAGACTGATCACCGCCAACCCTGTGATCACCGAGAGCACCGAG<br>AACAGCAAGATGATGCTGGAACTGGACCCCCCCTTCGGCGACTCCTACATCGTGA<br>TCGGCGTGGGAGAGAAGAAGATCACCCACCACTGGCACAGATCCGGCAGCACCAT | 49 |

TABLE 31-continued

ZIKV Nucleic Acid Sequences

| Description | Sequence | SEQ ID NO: |
|---|---|---|
| | CGGCAAGGCCTTTGAGGCTACAGTGCGGGGAGCCAAGAGAATGGCCGTGCTGGGC<br>GATACCGCCTGGGATTTTGGCTCTGTGGGCGGAGCCCTGAACAGCCTGGGAAAGG<br>GCATCCACCAGATCTTCGGCGCTGCCTTCAAGAGCCTGTTCGGCGGCATGAGCTG<br>GTTCAGCCAGATCCTGATCGGCACCCTGCTCGTGTGGCTGGGCCTGAACACCAAG<br>AACGGCAGCATCTCCCTGACCTGCCTGGCTCTGGGCGGCGTGCTGATCTTTCTGA<br>GCACAGCCGTGTCCGCCTGATAATAGGCTGGAGCCTCGGTGGCCATGCTTCTTGC<br>CCCTTGGGCCTCCCCCCAGCCCCTCCTCCCCTTCCTGCACCCGTACCCCCGTGGT<br>CTTTGAATAAAGTCTGAGTGGGCGGC | |
| IgE HC signal peptide_prM-E #1 (Brazil_ isolate_ ZikaSPH2015), ORF Sequence, NT | ATGGACTGGACCTGGATCCTGTTCCTGGTGGCCGCTGCCACAAGAGTGCACAGCG<br>TGGAAGTGACCAGACGGGGCAGCGCCTACTACATGTACCTGGACAGAAGCGACGC<br>CGGCGAGGCCATCAGCTTTCCAACCACCCTGGGCATGAACAAGTGCTACATCCAG<br>ATCATGGACCTGGGCCACATGTGCGACGCCACCATGAGCTACGAGTGCCCCATGC<br>TGGACGAGGGCGTGGAACCCGACGATGTGGACTGCTGGTGCAACACCACCAGCAC<br>CTGGGTGGTGTACGGCACCTGTCACCACAAGAAGGGCGAAGCCAGACGGTCCAGA<br>CGGGCCGTGACACTGCCTAGCCACAGCACCAGAAAGCTGCAGACCCGGTCCCAGA<br>CCTGGCTGGAAAGCAGAGAGTACACCAAGCACCTGATCCGGGTGGAAAACTGGAT<br>CTTCCGGAACCCCGGCTTTGCCCTGGCTGCCGCTGCTATTGCTTGGCTGCTGGGC<br>AGCAGCACCTCCCAGAAAGTGATCTACCTCGTGATGATCCTGCTGATCGCCCCTG<br>CCTACAGCATCCGGTGTATCGGCGTGTCCAACCGGGACTTCGTGGAAGGCATGAG<br>CGGCGGCACATGGGTGGACGTGGTGCTGGAACATGGCGGCTGCGTGACAGTGATG<br>GCCCAGGATAAGCCCGCCGTGGACATCGAGCTCGTGACCACCACCGTGTCCAATA<br>TGGCCGAAGTGCGGAGCTACTGCTACGAGGCCAGCATCAGCGACATGGCCAGCGA<br>CAGCAGATGCCCTACACAGGGCGAGGCCTACCTGGATAAGCAGTCCGACACCCAG<br>TACGTGTGCAAGCGGACCCTGGTGGATAGAGGCTGGGGCAATGGCTGCGGCCTGT<br>TTGGCAAGGGCAGCCTCGTGACCTGCGCCAAGTTCGCCTGCAGCAAGAAGATGAC<br>CGGCAAGAGCATCCAGCCCGAGAACCTGGAATACCGGATCATGCTGAGCGTGCAC<br>GGCTCCCAGCACAGCGGCATGATCGTGAACGACACCGGCCACGAGACAGACGAGA<br>ACCGGGCCAAGGTGGAAATCACCCCCAACAGCCCTAGAGCCGAGGCCACACTGGG<br>CGGCTTTGGATCTCTGGGCCTGGACTGCGAGCCTAGAACCGGCCTGGATTTCAGC<br>GACCTGTACTACCTGACCATGAACAACAAGCACTGGCTGGTGCACAAAGAGTGGT<br>TCCACGACATCCCCCTGCCCTGGCATGCTGGCGCTGATACAGGCACCCCCCACTG<br>GAACAACAAAGAGGCTCTGGTGGAATTCAAGGACGCCCACGCCAAGCGGCAGACC<br>GTGGTGGTGCTGGGATCTCAGGAAGGCGCCGTGCATACAGCTCTGGCTGGCGCCC<br>TGGAAGCCGAAATGGATGGCGCCAAAGGCAGACTGTCCTCCGGCCACCTGAAGTG<br>CCGGCTGAAGATGGACAAGCTGCGGCTGAAGGGCGTGTCCTACAGCCTGTGTACC<br>GCCGCCTTCACCTTCACCAAGATCCCCGCCGAGACACTGCACGGCACCGTGACTG<br>TGGAAGTGCAGTACGCCGGCACCGACGGCCCTTGTAAAGTGCCTGCTCAGATGGC<br>CGTGGATATGCAGACCCTGACCCCCGTGGGCAGACTGATCACCGCCAACCCTGTG<br>ATCACCGAGAGCACCGAGAACAGCAAGATGATGCTGGAACTGGACCCCCCCTTCG<br>GCGACTCCTACATCGTGATCGGCGTGGGAGAGAAGAAGATCACCCACCACTGGCA<br>CAGATCCGGCAGCACCATCGGCAAGGCCTTTGAGGCTACAGTGCGGGGAGCCAAG<br>AGAATGGCCGTGCTGGGCGATACCGCCTGGGATTTTGGCTCTGTGGGCGGAGCCC<br>TGAACAGCCTGGGAAAGGGCATCCACCAGATCTTCGGCGCTGCCTTCAAGAGCCT<br>GTTCGGCGGCATGAGCTGGTTCAGCCAGATCCTGATCGGCACCCTGCTCGTGTGG<br>CTGGGCCTGAACACCAAGAACGGCAGCATCTCCCTGACCTGCCTGGCTCTGGGCG<br>GCGTGCTGATCTTTCTGAGCACAGCCGTGTCCGCC | 50 |
| IgE HC signal peptide_prM-E #1 (Brazil_ isolate_ ZikaSPH2015), mRNA Sequence (T100 tail) | G*GGGAAATAAGAGAGAAAAGAAGAGTAAGAAGAAATATAAGAGCCACCATGGAC<br>TGGACCTGGATCCTGTTCCTGGTGGCCGCTGCCACAAGAGTGCACAGCGTGGAAG<br>TGACCAGACGGGGCAGCGCCTACTACATGTACCTGGACAGAAGCGACGCCGGCGA<br>GGCCATCAGCTTTCCAACCACCCTGGGCATGAACAAGTGCTACATCCAGATCATG<br>GACCTGGGCCACATGTGCGACGCCACCATGAGCTACGAGTGCCCCATGCTGGACG<br>AGGGCGTGGAACCCGACGATGTGGACTGCTGGTGCAACACCACCAGCACCTGGGT<br>GGTGTACGGCACCTGTCACCACAAGAAGGGCGAAGCCAGACGGTCCAGACGGGCC<br>GTGACACTGCCTAGCCACAGCACCAGAAAGCTGCAGACCCGGTCCCAGACCTGGC<br>TGGAAAGCAGAGAGTACACCAAGCACCTGATCCGGGTGGAAAACTGGATCTTCCG<br>GAACCCCGGCTTTGCCCTGGCTGCCGCTGCTATTGCTTGGCTGCTGGGCAGCAGC<br>ACCTCCCAGAAAGTGATCTACCTCGTGATGATCCTGCTGATCGCCCCTGCCTACA<br>GCATCCGGTGTATCGGCGTGTCCAACCGGGACTTCGTGGAAGGCATGAGCGGCGG<br>CACATGGGTGGACGTGGTGCTGGAACATGGCGGCTGCGTGACAGTGATGGCCCAG<br>GATAAGCCCGCCGTGGACATCGAGCTCGTGACCACCACCGTGTCCAATATGGCCG<br>AAGTGCGGAGCTACTGCTACGAGGCCAGCATCAGCGACATGGCCAGCGACAGCAG<br>ATGCCCTACACAGGGCGAGGCCTACCTGGATAAGCAGTCCGACACCCAGTACGTG<br>TGCAAGCGGACCCTGGTGGATAGAGGCTGGGGCAATGGCTGCGGCCTGTTTGGCA<br>AGGGCAGCCTCGTGACCTGCGCCAAGTTCGCCTGCAGCAAGAAGATGACCGGCAA<br>GAGCATCCAGCCCGAGAACCTGGAATACCGGATCATGCTGAGCGTGCACGGCTCC<br>CAGCACAGCGGCATGATCGTGAACGACACCGGCCACGAGACAGACGAGAACCGGG<br>CCAAGGTGGAAATCACCCCCAACAGCCCTAGAGCCGAGGCCACACTGGGCGGCTT<br>TGGATCTCTGGGCCTGGACTGCGAGCCTAGAACCGGCCTGGATTTCAGCGACCTG<br>TACTACCTGACCATGAACAACAAGCACTGGCTGGTGCACAAAGAGTGGTTCCACG<br>ACATCCCCCTGCCCTGGCATGCTGGCGCTGATACAGGCACCCCCCACTGGAACAA<br>CAAAGAGGCTCTGGTGGAATTCAAGGACGCCCACGCCAAGCGGCAGACCGTGGTG<br>GTGCTGGGATCTCAGGAAGGCGCCGTGCATACAGCTCTGGCTGGCGCCCTGGAAG | 51 |

TABLE 31-continued

<table>
<tr><th colspan="3">ZIKV Nucleic Acid Sequences</th></tr>
<tr><th>Description</th><th>Sequence</th><th>SEQ ID NO:</th></tr>
<tr><td></td><td>CCGAAATGGATGGCGCCAAAGGCAGACTGTCCTCCGGCCACCTGAAGTGCCGGCT<br>GAAGATGGACAAGCTGCGGCTGAAGGGCGTGTCCTACAGCCTGTGTACCGCCGCC<br>TTCACCTTCACCAAGATCCCCGCCGAGACACTGCACGGCACCGTGACTGTGGAAG<br>TGCAGTACGCCGGCACCGACGGCCCTTGTAAAGTGCCTGCTCAGATGGCCGTGGA<br>TATGCAGACCCTGACCCCCGTGGGCAGACTGATCACCGCCAACCCTGTGATCACC<br>GAGAGCACCGAGAACAGCAAGATGATGCTGGAACTGGACCCCCCCTTCGGCGACT<br>CCTACATCGTGATCGGCGTGGGAGAGAAGAAGATCACCCACCACTGGCACAGATC<br>CGGCAGCACCATCGGCAAGGCCTTTGAGGCTACAGTGCGGGGAGCCAAGAGAATG<br>GCCGTGCTGGGCGATACCGCCTGGGATTTTGGCTCTGTGGGCGGAGCCCTGAACA<br>GCCTGGGAAAGGGCATCCACCAGATCTTCGGCGCTGCCTTCAAGAGCCTGTTCGG<br>CGGCATGAGCTGGTTCAGCCAGATCCTGATCGGCACCCTGCTCGTGTGGCTGGGC<br>CTGAACACCAAGAACGGCAGCATCTCCCTGACCTGCCTGGCTCTGGGCGGCGTGC<br>TGATCTTTCTGAGCACAGCCGTGTCCGCCTGATAATAGGCTGGAGCCTCGGTGGC<br>CATGCTTCTTGCCCCTTGGGCCTCCCCCCAGCCCCTCCTCCCCTTCCTGCACCCG<br>TACCCCCGTGGTCTTTGAATAAAGTCTGAGTGGGCGGCAAAAAAAAAAAAAAAAA<br>AAAAAAAAAAAAAAAAAAAAAAAAAAAAAAAAAAAAAAAAAAAAAAAAAAAAAAA<br>AAAAAAAAAAAAAAAAAAAAAAAAAAAATCTAG</td><td></td></tr>
<tr><td>IgE HC signal peptide_prM-E #2 (Brazil_ isolate_ ZikaSPH2015), Sequence, NT (5' UTR, ORF, 3' UTR)</td><td>TCAAGCTTTTGGACCCTCGTACAGAAGCTAATACGACTCACTATAGGGAAATAAG<br>AGAGAAAAGAAGAGTAAGAAGAAATATAAGAGCCACCATGGACTGGACCTGGATC<br>CTGTTCCTGGTGGCCGCTGCCACAAGAGTGCACAGCACCAGAAGAGGCAGCGCCT<br>ACTACATGTACCTGGACAGAAGCGACGCCGGCGAGGCCATCAGCTTTCCAACCAC<br>CCTGGGCATGAACAAGTGCTACATCCAGATCATGGACCTGGGCCACATGTGCGAC<br>GCCACCATGAGCTACGAGTGCCCCATGCTGGACGAGGGCGTGGAACCCGACGATG<br>TGGACTGCTGGTGCAACACCACCAGCACCTGGGTGGTGTACGGCACCTGTCACCA<br>CAAGAAGGGCGAAGCCAGACGGTCCAGACGGGCCGTGACACTGCCTAGCCACTCC<br>ACCAGAAAGCTGCAGACCCGGTCCCAGACCTGGCTGGAAAGCAGAGAGTACACCA<br>AGCACCTGATCCGGGTGGAAAACTGGATCTTCCGGAACCCCGGCTTTGCCCTGGC<br>TGCCGCTGCTATTGCTTGGCTGCTGGGCAGCAGCACCTCCCAGAAAGTGATCTAC<br>CTCGTGATGATCCTGCTGATCGCCCCTGCCTACAGCATCCGGTGTATCGGCGTGT<br>CCAACCGGGACTTCGTGGAAGGCATGAGCGGCGGCACATGGGTGGACGTGGTGCT<br>GGAACATGGCGGCTGCGTGACAGTGATGGCCCAGGATAAGCCCGCCGTGGACATC<br>GAGCTCGTGACCACCACCGTGTCCAATATGGCCGAAGTGCGGAGCTACTGCTACG<br>AGGCCAGCATCAGCGACATGGCCAGCGACAGCAGATGCCCTACACAGGGCGAGGC<br>CTACCTGGATAAGCAGTCCGACACCCAGTACGTGTGCAAGCGGACCCTGGTGGAT<br>AGAGGCTGGGGCAATGGCTGCGGCCTGTTTGGCAAGGGCAGCCTCGTGACCTGCG<br>CCAAGTTCGCCTGCAGCAAGAAGATGACCGGCAAGAGCATCCAGCCCGAGAACCT<br>GGAATACCGGATCATGCTGAGCGTGCACGGCTCCCAGCACAGCGGCATGATCGTG<br>AACGACACCGGCCACGAGACAGACGAGAACCGGGCCAAGGTGGAAATCACCCCCA<br>ACAGCCCTAGAGCCGAGGCCACACTGGGCGGCTTTGGATCTCTGGGCCTGGACTG<br>CGAGCCTAGAACCGGCCTGGATTTCAGCGACCTGTACTACCTGACCATGAACAAC<br>AAGCACTGGCTGGTGCACAAAGAGTGGTTCCACGACATCCCCCTGCCCTGGCATG<br>CTGGCGCTGATACAGGCACCCCCCACTGGAACAACAAAGAGGCTCTGGTGGAATT<br>CAAGGACGCCCACGCCAAGCGGCAGACCGTGGTGGTGCTGGGATCTCAGGAAGGC<br>GCCGTGCATACAGCTCTGGCTGGCGCCCTGGAAGCCGAAATGGATGGCGCCAAAG<br>GCAGACTGTCCTCCGGCCACCTGAAGTGCCGGCTGAAGATGGACAAGCTGCGGCT<br>GAAGGGCGTGTCCTACAGCCTGTGTACCGCCGCCTTCACCTTCACCAAGATCCCC<br>GCCGAGACACTGCACGGCACCGTGACTGTGGAAGTGCAGTACGCCGGCACCGACG<br>GCCCTTGTAAAGTGCCTGCTCAGATGGCCGTGGATATGCAGACCCTGACCCCCGT<br>GGGCAGACTGATCACCGCCAACCCTGTGATCACCGAGAGCACCGAGAACAGCAAG<br>ATGATGCTGGAACTGGACCCCCCCTTCGGCGACTCCTACATCGTGATCGGCGTGG<br>GAGAGAAGAAGATCACCCACCACTGGCACAGATCCGGCAGCACCATCGGCAAGGC<br>CTTTGAGGCTACAGTGCGGGGAGCCAAGAGAATGGCCGTGCTGGGCGATACCGCC<br>TGGGATTTTGGCTCTGTGGGCGGAGCCCTGAACAGCCTGGGAAAGGGCATCCACC<br>AGATCTTCGGAGCCGCCTTTAAGAGCCTGTTCGGCGGCATGAGCTGGTTCAGCCA<br>GATCCTGATCGGCACCCTGCTCGTGTGGCTGGGCCTGAACACCAAGAACGGCAGC<br>ATCTCCCTGACCTGCCTGGCTCTGGGCGGCGTGCTGATCTTTCTGAGCACAGCCG<br>TGTCCGCCTGATAATAGGCTGGAGCCTCGGTGGCCATGCTTCTTGCCCCTTGGGC<br>CTCCCCCCAGCCCCTCCTCCCCTTCCTGCACCCGTACCCCCGTGGTCTTTGAATA<br>AAGTCTGAGTGGGCGGC</td><td>52</td></tr>
<tr><td>IgE HC signal peptide_prM-E #2 (Brazil_ isolate_ ZikaSPH2015), ORF Sequence, NT</td><td>ATGGACTGGACCTGGATCCTGTTCCTGGTGGCCGCTGCCACAAGAGTGCACAGCA<br>CCAGAAGAGGCAGCGCCTACTACATGTACCTGGACAGAAGCGACGCCGGCGAGGC<br>CATCAGCTTTCCAACCACCCTGGGCATGAACAAGTGCTACATCCAGATCATGGAC<br>CTGGGCCACATGTGCGACGCCACCATGAGCTACGAGTGCCCCATGCTGGACGAGG<br>GCGTGGAACCCGACGATGTGGACTGCTGGTGCAACACCACCAGCACCTGGGTGGT<br>GTACGGCACCTGTCACCACAAGAAGGGCGAAGCCAGACGGTCCAGACGGGCCGTG<br>ACACTGCCTAGCCACTCCACCAGAAAGCTGCAGACCCGGTCCCAGACCTGGCTGG<br>AAAGCAGAGAGTACACCAAGCACCTGATCCGGGTGGAAAACTGGATCTTCCGGAA<br>CCCCGGCTTTGCCCTGGCTGCCGCTGCTATTGCTTGGCTGCTGGGCAGCAGCACC<br>TCCCAGAAAGTGATCTACCTCGTGATGATCCTGCTGATCGCCCCTGCCTACAGCA<br>TCCGGTGTATCGGCGTGTCCAACCGGGACTTCGTGGAAGGCATGAGCGGCGGCAC<br>ATGGGTGGACGTGGTGCTGGAACATGGCGGCTGCGTGACAGTGATGGCCCAGGAT<br>AAGCCCGCCGTGGACATCGAGCTCGTGACCACCACCGTGTCCAATATGGCCGAAG</td><td>53</td></tr>
</table>

TABLE 31-continued

ZIKV Nucleic Acid Sequences

| Description | Sequence | SEQ ID NO: |
|---|---|---|
| | TGCGGAGCTACTGCTACGAGGCCAGCATCAGCGACATGGCCAGCGACAGCAGATG<br>CCCTACACAGGGCGAGGCCTACCTGGATAAGCAGTCCGACACCCAGTACGTGTGC<br>AAGCGGACCCTGGTGGATAGAGGCTGGGGCAATGGCTGCGGCCTGTTTGGCAAGG<br>GCAGCCTCGTGACCTGCGCCAAGTTCGCCTGCAGCAAGAAGATGACCGGCAAGAG<br>CATCCAGCCCGAGAACCTGGAATACCGGATCATGCTGAGCGTGCACGGCTCCCAG<br>CACAGCGGCATGATCGTGAACGACACCGGCCACGAGACAGACGAGAACCGGGCCA<br>AGGTGGAAATCACCCCCAACAGCCCTAGAGCCGAGGCCACACTGGGCGGCTTTGG<br>ATCTCTGGGCCTGGACTGCGAGCCTAGAACCGGCCTGGATTTCAGCGACCTGTAC<br>TACCTGACCATGAACAACAAGCACTGGCTGGTGCACAAAGAGTGGTTCCACGACA<br>TCCCCCTGCCCTGGCATGCTGGCGCTGATACAGGCACCCCCCACTGGAACAACAA<br>AGAGGCTCTGGTGGAATTCAAGGACGCCCACGCCAAGCGGCAGACCGTGGTGGTG<br>CTGGGATCTCAGGAAGGCGCCGTGCATACAGCTCTGGCTGGCGCCCTGGAAGCCG<br>AAATGGATGGCGCCAAAGGCAGACTGTCCTCCGGCCACCTGAAGTGCCGGCTGAA<br>GATGGACAAGCTGCGGCTGAAGGGCGTGTCCTACAGCCTGTGTACCGCCGCCTTC<br>ACCTTCACCAAGATCCCCGCCGAGACACTGCACGGCACCGTGACTGTGGAAGTGC<br>AGTACGCCGGCACCGACGGCCCTTGTAAAGTGCCTGCTCAGATGGCCGTGGATAT<br>GCAGACCCTGACCCCCGTGGGCAGACTGATCACCGCCAACCCTGTGATCACCGAG<br>AGCACCGAGAACAGCAAGATGATGCTGGAACTGGACCCCCCCTTCGGCGACTCCT<br>ACATCGTGATCGGCGTGGGAGAGAAGAAGATCACCCACCACTGGCACAGATCCGG<br>CAGCACCATCGGCAAGGCCTTTGAGGCTACAGTGCGGGGAGCCAAGAGAATGGCC<br>GTGCTGGGCGATACCGCCTGGGATTTTGGCTCTGTGGGCGGAGCCCTGAACAGCC<br>TGGGAAAGGGCATCCACCAGATCTTCGGAGCCGCCTTTAAGAGCCTGTTCGGCGG<br>CATGAGCTGGTTCAGCCAGATCCTGATCGGCACCCTGCTCGTGTGGCTGGGCCTG<br>AACACCAAGAACGGCAGCATCTCCCTGACCTGCCTGGCTCTGGGCGGCGTGCTGA<br>TCTTTCTGAGCACAGCCGTGTCCGCC | |
| IgE HC signal<br>peptide_prM-E<br>#2<br>(Brazil_<br>isolate_<br>ZikaSPH2015),<br>mRNA<br>Sequence<br>(T100 tail) | G*GGGAAATAAGAGAGAAAAGAAGAGTAAGAAGAAATATAAGAGCCACCATGGAC<br>TGGACCTGGATCCTGTTCCTGGTGGCCGCTGCCACAAGAGTGCACAGCACCAGAA<br>GAGGCAGCGCCTACTACATGTACCTGGACAGAAGCGACGCCGGCGAGGCCATCAG<br>CTTTCCAACCACCCTGGGCATGAACAAGTGCTACATCCAGATCATGGACCTGGGC<br>CACATGTGCGACGCCACCATGAGCTACGAGTGCCCCATGCTGGACGAGGGCGTGG<br>AACCCGACGATGTGGACTGCTGGTGCAACACCACCAGCACCTGGGTGGTGTACGG<br>CACCTGTCACCACAAGAAGGGCGAAGCCAGACGGTCCAGACGGGCCGTGACACTG<br>CCTAGCCACTCCACCAGAAAGCTGCAGACCCGGTCCCAGACCTGGCTGGAAAGCA<br>GAGAGTACACCAAGCACCTGATCCGGGTGGAAAACTGGATCTTCCGGAACCCCGG<br>CTTTGCCCTGGCTGCCGCTGCTATTGCTTGGCTGCTGGGCAGCAGCACCTCCCAG<br>AAAGTGATCTACCTCGTGATGATCCTGCTGATCGCCCCTGCCTACAGCATCCGGT<br>GTATCGGCGTGTCCAACCGGGACTTCGTGGAAGGCATGAGCGGCGGCACATGGGT<br>GGACGTGGTGCTGGAACATGGCGGCTGCGTGACAGTGATGGCCCAGGATAAGCCC<br>GCCGTGGACATCGAGCTCGTGACCACCACCGTGTCCAATATGGCCGAAGTGCGGA<br>GCTACTGCTACGAGGCCAGCATCAGCGACATGGCCAGCGACAGCAGATGCCCTAC<br>ACAGGGCGAGGCCTACCTGGATAAGCAGTCCGACACCCAGTACGTGTGCAAGCGG<br>ACCCTGGTGGATAGAGGCTGGGGCAATGGCTGCGGCCTGTTTGGCAAGGGCAGCC<br>TCGTGACCTGCGCCAAGTTCGCCTGCAGCAAGAAGATGACCGGCAAGAGCATCCA<br>GCCCGAGAACCTGGAATACCGGATCATGCTGAGCGTGCACGGCTCCCAGCACAGC<br>GGCATGATCGTGAACGACACCGGCCACGAGACAGACGAGAACCGGGCCAAGGTGG<br>AAATCACCCCCAACAGCCCTAGAGCCGAGGCCACACTGGGCGGCTTTGGATCTCT<br>GGGCCTGGACTGCGAGCCTAGAACCGGCCTGGATTTCAGCGACCTGTACTACCTG<br>ACCATGAACAACAAGCACTGGCTGGTGCACAAAGAGTGGTTCCACGACATCCCCC<br>TGCCCTGGCATGCTGGCGCTGATACAGGCACCCCCCACTGGAACAACAAAGAGGC<br>TCTGGTGGAATTCAAGGACGCCCACGCCAAGCGGCAGACCGTGGTGGTGCTGGGA<br>TCTCAGGAAGGCGCCGTGCATACAGCTCTGGCTGGCGCCCTGGAAGCCGAAATGG<br>ATGGCGCCAAAGGCAGACTGTCCTCCGGCCACCTGAAGTGCCGGCTGAAGATGGA<br>CAAGCTGCGGCTGAAGGGCGTGTCCTACAGCCTGTGTACCGCCGCCTTCACCTTC<br>ACCAAGATCCCCGCCGAGACACTGCACGGCACCGTGACTGTGGAAGTGCAGTACG<br>CCGGCACCGACGGCCCTTGTAAAGTGCCTGCTCAGATGGCCGTGGATATGCAGAC<br>CCTGACCCCCGTGGGCAGACTGATCACCGCCAACCCTGTGATCACCGAGAGCACC<br>GAGAACAGCAAGATGATGCTGGAACTGGACCCCCCCTTCGGCGACTCCTACATCG<br>TGATCGGCGTGGGAGAGAAGAAGATCACCCACCACTGGCACAGATCCGGCAGCAC<br>CATCGGCAAGGCCTTTGAGGCTACAGTGCGGGGAGCCAAGAGAATGGCCGTGCTG<br>GGCGATACCGCCTGGGATTTTGGCTCTGTGGGCGGAGCCCTGAACAGCCTGGGAA<br>AGGGCATCCACCAGATCTTCGGAGCCGCCTTTAAGAGCCTGTTCGGCGGCATGAG<br>CTGGTTCAGCCAGATCCTGATCGGCACCCTGCTCGTGTGGCTGGGCCTGAACACC<br>AAGAACGGCAGCATCTCCCTGACCTGCCTGGCTCTGGGCGGCGTGCTGATCTTTC<br>TGAGCACAGCCGTGTCCGCCTGATAATAGGCTGGAGCCTCGGTGGCCATGCTTCT<br>TGCCCCTTGGGCCTCCCCCCAGCCCCTCCTCCCCTTCCTGCACCCGTACCCCCGT<br>GGTCTTTGAATAAAGTCTGAGTGGGCGGCAAAAAAAAAAAAAAAAAAAAAAAAAA<br>AAAAAAAAAAAAAAAAAAAAAAAAAAAAAAAAAAAAAAAAAAAAAAAAAAAAAAA<br>AAAAAAAAAAAAAAAAAAAAATCTAG | 54 |

TABLE 31-continued

| ZIKV Nucleic Acid Sequences | | |
|---|---|---|
| Description | Sequence | SEQ ID NO: |
| HuIgG$_k$ signal peptide_prME #1 (Brazil_ isolate_ ZikaSPH2015), Sequence, NT (5' UTR, ORF, 3' UTR) | TCAAGCTTTTGGACCCTCGTACAGAAGCTAATACGACTCACTATAGGGAAATAAG<br>AGAGAAAAGAAGAGTAAGAAGAAATATAAGAGCCACCATGGAAACCCCTGCCCAG<br>CTGCTGTTCCTGCTGCTGCTGTGGCTGCCTGATACCACCGGCGTGGAAGTGACCA<br>GAAGAGGCAGCGCCTACTACATGTACCTGGACAGAAGCGACGCCGGCGAGGCCAT<br>CAGCTTTCCAACCACCCTGGGCATGAACAAGTGCTACATCCAGATCATGGACCTG<br>GGCCACATGTGCGACGCCACCATGAGCTACGAGTGCCCCATGCTGGACGAGGGCG<br>TGGAACCCGACGATGTGGACTGCTGGTGCAACACCACCAGCACCTGGGTGGTGTA<br>CGGCACCTGTCACCACAAGAAGGGCGAAGCCAGACGGTCCAGACGGGCCGTGACA<br>CTGCCTAGCCACTCCACCAGAAAGCTGCAGACCCGGTCCCAGACCTGGCTGGAAA<br>GCAGAGAGTACACCAAGCACCTGATCCGGGTGGAAAACTGGATCTTCCGGAACCC<br>CGGCTTTGCCCTGGCCGCTGCTGCTATTGCTTGGCTGCTGGGCAGCAGCACCTCC<br>CAGAAAGTGATCTACCTCGTGATGATCCTGCTGATCGCCCCTGCCTACAGCATCC<br>GGTGTATCGGCGTGTCCAACCGGGACTTCGTGGAAGGCATGAGCGGCGGCACATG<br>GGTGGACGTGGTGCTGGAACATGGCGGCTGCGTGACAGTGATGGCCCAGGATAAG<br>CCCGCCGTGGACATCGAGCTCGTGACCACCACCGTGTCCAATATGGCCGAAGTGC<br>GGAGCTACTGCTACGAGGCCAGCATCAGCGACATGGCCAGCGACAGCAGATGCCC<br>TACACAGGGCGAGGCCTACCTGGATAAGCAGTCCGACACCCAGTACGTGTGCAAG<br>CGGACCCTGGTGGATAGAGGCTGGGGCAATGGCTGCGGCCTGTTTGGCAAGGGCA<br>GCCTCGTGACCTGCGCCAAGTTCGCCTGCAGCAAGAAGATGACCGGCAAGAGCAT<br>CCAGCCCGAGAACCTGGAATACCGGATCATGCTGAGCGTGCACGGCAGCCAGCAC<br>TCCGGCATGATCGTGAACGACACCGGCCACGAGACAGACGAGAACCGGGCCAAGG<br>TGGAAATCACCCCCAACAGCCCTAGAGCCGAGGCCACACTGGGCGGCTTTGGATC<br>TCTGGGCCTGGACTGCGAGCCTAGAACCGGCCTGGATTTCAGCGACCTGTACTAC<br>CTGACCATGAACAACAAGCACTGGCTGGTGCACAAAGAGTGGTTCCACGACATCC<br>CCCTGCCCTGGCATGCCGGCGCTGATACAGGCACACCCCACTGGAACAACAAAGA<br>GGCTCTGGTGGAATTCAAGGACGCCCACGCCAAGCGGCAGACCGTGGTGGTGCTG<br>GGATCTCAGGAAGGCGCCGTGCATACAGCTCTGGCTGGCGCCCTGGAAGCCGAAA<br>TGGATGGCGCCAAAGGCAGACTGTCCAGCGGCCACCTGAAGTGCCGGCTGAAGAT<br>GGACAAGCTGCGGCTGAAGGGCGTGTCCTACAGCCTGTGTACCGCCGCCTTCACC<br>TTCACCAAGATCCCCGCCGAGACACTGCACGGCACCGTGACTGTGGAAGTGCAGT<br>ACGCCGGCACCGACGGCCCTTGTAAAGTGCCTGCTCAGATGGCCGTGGATATGCA<br>GACCCTGACCCCCGTGGGCAGACTGATCACCGCCAACCCTGTGATCACCGAGAGC<br>ACCGAGAACAGCAAGATGATGCTGGAACTGGACCCCCCCTTCGGCGACTCCTACA<br>TCGTGATCGGCGTGGGAGAGAAGAAGATCACCCACCACTGGCACCGCAGCGGCAG<br>CACAATCGGCAAGGCCTTTGAAGCCACAGTGCGGGGAGCCAAGAGAATGGCCGTG<br>CTGGGAGATACCGCCTGGGACTTTGGCTCTGTGGGCGGAGCCCTGAACTCTCTGG<br>GCAAGGGAATCCACCAGATCTTCGGAGCCGCCTTTAAGAGCCTGTTCGGCGGCAT<br>GAGCTGGTTCAGCCAGATCCTGATCGGCACCCTGCTCGTGTGGCTGGGCCTGAAC<br>ACCAAGAACGGCAGCATCTCCCTGACCTGCCTGGCTCTGGGAGGCGTGCTGATCT<br>TTCTGAGCACCGCCGTGTCTGCCTGATAATAGGCTGGAGCCTCGGTGGCCATGCT<br>TCTTGCCCCTTGGGCCTCCCCCCAGCCCCTCCTCCCCTTCCTGCACCCGTACCCC<br>CGTGGTCTTTGAATAAAGTCTGAGTGGGCGGC | 55 |
| HuIgG$_k$ signal peptide_prME #1 (Brazil_ isolate_ ZikaSPH2015), ORF Sequence, NT | ATGGAAACCCCTGCCCAGCTGCTGTTCCTGCTGCTGCTGTGGCTGCCTGATACCA<br>CCGGCGTGGAAGTGACCAGAAGAGGCAGCGCCTACTACATGTACCTGGACAGAAG<br>CGACGCCGGCGAGGCCATCAGCTTTCCAACCACCCTGGGCATGAACAAGTGCTAC<br>ATCCAGATCATGGACCTGGGCCACATGTGCGACGCCACCATGAGCTACGAGTGCC<br>CCATGCTGGACGAGGGCGTGGAACCCGACGATGTGGACTGCTGGTGCAACACCAC<br>CAGCACCTGGGTGGTGTACGGCACCTGTCACCACAAGAAGGGCGAAGCCAGACGG<br>TCCAGACGGGCCGTGACACTGCCTAGCCACTCCACCAGAAAGCTGCAGACCCGGT<br>CCCAGACCTGGCTGGAAAGCAGAGAGTACACCAAGCACCTGATCCGGGTGGAAAA<br>CTGGATCTTCCGGAACCCCGGCTTTGCCCTGGCCGCTGCTGCTATTGCTTGGCTG<br>CTGGGCAGCAGCACCTCCCAGAAAGTGATCTACCTCGTGATGATCCTGCTGATCG<br>CCCCTGCCTACAGCATCCGGTGTATCGGCGTGTCCAACCGGGACTTCGTGGAAGG<br>CATGAGCGGCGGCACATGGGTGGACGTGGTGCTGGAACATGGCGGCTGCGTGACA<br>GTGATGGCCCAGGATAAGCCCGCCGTGGACATCGAGCTCGTGACCACCACCGTGT<br>CCAATATGGCCGAAGTGCGGAGCTACTGCTACGAGGCCAGCATCAGCGACATGGC<br>CAGCGACAGCAGATGCCCTACACAGGGCGAGGCCTACCTGGATAAGCAGTCCGAC<br>ACCCAGTACGTGTGCAAGCGGACCCTGGTGGATAGAGGCTGGGGCAATGGCTGCG<br>GCCTGTTTGGCAAGGGCAGCCTCGTGACCTGCGCCAAGTTCGCCTGCAGCAAGAA<br>GATGACCGGCAAGAGCATCCAGCCCGAGAACCTGGAATACCGGATCATGCTGAGC<br>GTGCACGGCAGCCAGCACTCCGGCATGATCGTGAACGACACCGGCCACGAGACAG<br>ACGAGAACCGGGCCAAGGTGGAAATCACCCCCAACAGCCCTAGAGCCGAGGCCAC<br>ACTGGGCGGCTTTGGATCTCTGGGCCTGGACTGCGAGCCTAGAACCGGCCTGGAT<br>TTCAGCGACCTGTACTACCTGACCATGAACAACAAGCACTGGCTGGTGCACAAAG<br>AGTGGTTCCACGACATCCCCCTGCCCTGGCATGCCGGCGCTGATACAGGCACACC<br>CCACTGGAACAACAAAGAGGCTCTGGTGGAATTCAAGGACGCCCACGCCAAGCGG<br>CAGACCGTGGTGGTGCTGGGATCTCAGGAAGGCGCCGTGCATACAGCTCTGGCTG<br>GCGCCCTGGAAGCCGAAATGGATGGCGCCAAAGGCAGACTGTCCAGCGGCCACCT<br>GAAGTGCCGGCTGAAGATGGACAAGCTGCGGCTGAAGGGCGTGTCCTACAGCCTG<br>TGTACCGCCGCCTTCACCTTCACCAAGATCCCCGCCGAGACACTGCACGGCACCG<br>TGACTGTGGAAGTGCAGTACGCCGGCACCGACGGCCCTTGTAAAGTGCCTGCTCA<br>GATGGCCGTGGATATGCAGACCCTGACCCCCGTGGGCAGACTGATCACCGCCAAC | 56 |

TABLE 31-continued

ZIKV Nucleic Acid Sequences

| Description | Sequence | SEQ ID NO: |
|---|---|---|
| | CCTGTGATCACCGAGAGCACCGAGAACAGCAAGATGATGCTGGAACTGGACCCCC<br>CCTTCGGCGACTCCTACATCGTGATCGGCGTGGGAGAGAAGAAGATCACCCACCA<br>CTGGCACCGCAGCGGCAGCACAATCGGCAAGGCCTTTGAAGCCACAGTGCGGGGA<br>GCCAAGAGAATGGCCGTGCTGGGAGATACCGCCTGGGACTTTGGCTCTGTGGGCG<br>GAGCCCTGAACTCTCTGGGCAAGGGAATCCACCAGATCTTCGGAGCCGCCTTTAA<br>GAGCCTGTTCGGCGGCATGAGCTGGTTCAGCCAGATCCTGATCGGCACCCTGCTC<br>GTGTGGCTGGGCCTGAACACCAAGAACGGCAGCATCTCCCTGACCTGCCTGGCTC<br>TGGGAGGCGTGCTGATCTTTCTGAGCACCGCCGTGTCTGCC | |
| HuIgG$_k$ signal peptide_prME #1 (Brazil_ isolate_ ZikaSPH2015), mRNA Sequence (T100 tail) | G*GGGAAATAAGAGAGAAAAGAAGAGTAAGAAGAAATATAAGAGCCACCATGGAA<br>ACCCCTGCCCAGCTGCTGTTCCTGCTGCTGCTGTGGCTGCCTGATACCACCGGCG<br>TGGAAGTGACCAGAAGAGGCAGCGCCTACTACATGTACCTGGACAGAAGCGACGC<br>CGGCGAGGCCATCAGCTTTCCAACCACCCTGGGCATGAACAAGTGCTACATCCAG<br>ATCATGGACCTGGGCCACATGTGCGACGCCACCATGAGCTACGAGTGCCCCATGC<br>TGGACGAGGGCGTGGAACCCGACGATGTGGACTGCTGGTGCAACACCACCAGCAC<br>CTGGGTGGTGTACGGCACCTGTCACCACAAGAAGGGCGAAGCCAGACGGTCCAGA<br>CGGGCCGTGACACTGCCTAGCCACTCCACCAGAAAGCTGCAGACCCGGTCCCAGA<br>CCTGGCTGGAAAGCAGAGAGTACACCAAGCACCTGATCCGGGTGGAAAACTGGAT<br>CTTCCGGAACCCCGGCTTTGCCCTGGCCGCTGCTGCTATTGCTTGGCTGCTGGGC<br>AGCAGCACCTCCCAGAAAGTGATCTACCTCGTGATGATCCTGCTGATCGCCCCTG<br>CCTACAGCATCCGGTGTATCGGCGTGTCCAACCGGGACTTCGTGGAAGGCATGAG<br>CGGCGGCACATGGGTGGACGTGGTGCTGGAACATGGCGGCTGCGTGACAGTGATG<br>GCCCAGGATAAGCCCGCCGTGGACATCGAGCTCGTGACCACCACCGTGTCCAATA<br>TGGCCGAAGTGCGGAGCTACTGCTACGAGGCCAGCATCAGCGACATGGCCAGCGA<br>CAGCAGATGCCCTACACAGGGCGAGGCCTACCTGGATAAGCAGTCCGACACCCAG<br>TACGTGTGCAAGCGGACCCTGGTGGATAGAGGCTGGGGCAATGGCTGCGGCCTGT<br>TTGGCAAGGGCAGCCTCGTGACCTGCGCCAAGTTCGCCTGCAGCAAGAAGATGAC<br>CGGCAAGAGCATCCAGCCCGAGAACCTGGAATACCGGATCATGCTGAGCGTGCAC<br>GGCAGCCAGCACTCCGGCATGATCGTGAACGACACCGGCCACGAGACAGACGAGA<br>ACCGGGCCAAGGTGGAAATCACCCCCAACAGCCCTAGAGCCGAGGCCACACTGGG<br>CGGCTTTGGATCTCTGGGCCTGGACTGCGAGCCTAGAACCGGCCTGGATTTCAGC<br>GACCTGTACTACCTGACCATGAACAACAAGCACTGGCTGGTGCACAAAGAGTGGT<br>TCCACGACATCCCCCTGCCCTGGCATGCCGGCGCTGATACAGGCACACCCCACTG<br>GAACAACAAAGAGGCTCTGGTGGAATTCAAGGACGCCCACGCCAAGCGGCAGACC<br>GTGGTGGTGCTGGGATCTCAGGAAGGCGCCGTGCATACAGCTCTGGCTGGCGCCC<br>TGGAAGCCGAAATGGATGGCGCCAAAGGCAGACTGTCCAGCGGCCACCTGAAGTG<br>CCGGCTGAAGATGGACAAGCTGCGGCTGAAGGGCGTGTCCTACAGCCTGTGTACC<br>GCCGCCTTCACCTTCACCAAGATCCCCGCCGAGACACTGCACGGCACCGTGACTG<br>TGGAAGTGCAGTACGCCGGCACCGACGGCCCTTGTAAAGTGCCTGCTCAGATGGC<br>CGTGGATATGCAGACCCTGACCCCCGTGGGCAGACTGATCACCGCCAACCCTGTG<br>ATCACCGAGAGCACCGAGAACAGCAAGATGATGCTGGAACTGGACCCCCCCTTCG<br>GCGACTCCTACATCGTGATCGGCGTGGGAGAGAAGAAGATCACCCACCACTGGCA<br>CCGCAGCGGCAGCACAATCGGCAAGGCCTTTGAAGCCACAGTGCGGGGAGCCAAG<br>AGAATGGCCGTGCTGGGAGATACCGCCTGGGACTTTGGCTCTGTGGGCGGAGCCC<br>TGAACTCTCTGGGCAAGGGAATCCACCAGATCTTCGGAGCCGCCTTTAAGAGCCT<br>GTTCGGCGGCATGAGCTGGTTCAGCCAGATCCTGATCGGCACCCTGCTCGTGTGG<br>CTGGGCCTGAACACCAAGAACGGCAGCATCTCCCTGACCTGCCTGGCTCTGGGAG<br>GCGTGCTGATCTTTCTGAGCACCGCCGTGTCTGCCTGATAATAGGCTGGAGCCTC<br>GGTGGCCATGCTTCTTGCCCCTTGGGCCTCCCCCCAGCCCCTCCTCCCCTTCCTG<br>CACCCGTACCCCCGTGGTCTTTGAATAAAGTCTGAGTGGGCGGCAAAAAAAAAAA<br>AAAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAATCTAG | 57 |
| HuIgG$_k$ signal peptide_prME #2 (Brazil_ isolate_ ZikaSPH2015), Sequence, NT (5' UTR, ORF, 3' UTR) | TCAAGCTTTTGGACCCTCGTACAGAAGCTAATACGACTCACTATAGGGAAATAAG<br>AGAGAAAAGAAGAGTAAGAAGAAATATAAGAGCCACCATGGAAACCCCTGCCCAG<br>CTGCTGTTCCTGCTGCTGCTGTGGCTGCCTGATACCACCGGCACCAGAAGAGGCA<br>GCGCCTACTACATGTACCTGGACAGAAGCGACGCCGGCGAGGCCATCAGCTTTCC<br>AACCACCCTGGGCATGAACAAGTGCTACATCCAGATCATGGACCTGGGCCACATG<br>TGCGACGCCACCATGAGCTACGAGTGCCCCATGCTGGACGAGGGCGTGGAACCCG<br>ACGATGTGGACTGCTGGTGCAACACCACCAGCACCTGGGTGGTGTACGGCACCTG<br>TCACCACAAGAAGGGCGAAGCCAGACGGTCCAGACGGGCCGTGACACTGCCTAGC<br>CACTCCACCAGAAAGCTGCAGACCCGGTCCCAGACCTGGCTGGAAAGCAGAGAGT<br>ACACCAAGCACCTGATCCGGGTGGAAAACTGGATCTTCCGGAACCCCGGCTTTGC<br>CCTGGCCGCTGCTGCTATTGCTTGGCTGCTGGGCAGCAGCACCTCCCAGAAAGTG<br>ATCTACCTCGTGATGATCCTGCTGATCGCCCCTGCCTACAGCATCCGGTGTATCG<br>GCGTGTCCAACCGGGACTTCGTGGAAGGCATGAGCGGCGGCACATGGGTGGACGT<br>GGTGCTGGAACATGGCGGCTGCGTGACAGTGATGGCCCAGGATAAGCCCGCCGTG<br>GACATCGAGCTCGTGACCACCACCGTGTCCAATATGGCCGAAGTGCGGAGCTACT<br>GCTACGAGGCCAGCATCAGCGACATGGCCAGCGACAGCAGATGCCCTACACAGGG<br>CGAGGCCTACCTGGATAAGCAGTCCGACACCCAGTACGTGTGCAAGCGGACCCTG<br>GTGGATAGAGGCTGGGGCAATGGCTGCGGCCTGTTTGGCAAGGGCAGCCTCGTGA<br>CCTGCGCCAAGTTCGCCTGCAGCAAGAAGATGACCGGCAAGAGCATCCAGCCCGA<br>GAACCTGGAATACCGGATCATGCTGAGCGTGCACGGCAGCCAGCACTCCGGCATG<br>ATCGTGAACGACACCGGCCACGAGACAGACGAGAACCGGGCCAAGGTGGAAATCA | 58 |

TABLE 31-continued

ZIKV Nucleic Acid Sequences

| Description | Sequence | SEQ ID NO: |
|---|---|---|
| | CCCCCAACAGCCCTAGAGCCGAGGCCACACTGGGCGGCTTTGGATCTCTGGGCCT<br>GGACTGCGAGCCTAGAACCGGCCTGGATTTCAGCGACCTGTACTACCTGACCATG<br>AACAACAAGCACTGGCTGGTGCACAAAGAGTGGTTCCACGACATCCCCCTGCCCT<br>GGCATGCCGGCGCTGATACAGGCACACCCCACTGGAACAACAAAGAGGCTCTGGT<br>GGAATTCAAGGACGCCCACGCCAAGCGGCAGACCGTGGTGGTGCTGGGATCTCAG<br>GAAGGCGCCGTGCATACAGCTCTGGCTGGCGCCCTGGAAGCCGAAATGGATGGCG<br>CCAAAGGCAGACTGTCCAGCGGCCACCTGAAGTGCCGGCTGAAGATGGACAAGCT<br>GCGGCTGAAGGGCGTGTCCTACAGCCTGTGTACCGCCGCCTTCACCTTCACCAAG<br>ATCCCCGCCGAGACACTGCACGGCACCGTGACTGTGGAAGTGCAGTACGCCGGCA<br>CCGACGGCCCTTGTAAAGTGCCTGCTCAGATGGCCGTGGATATGCAGACCCTGAC<br>CCCCGTGGGCAGACTGATCACCGCCAACCCTGTGATCACCGAGAGCACCGAGAAC<br>AGCAAGATGATGCTGGAACTGGACCCCCCCTTCGGCGACTCCTACATCGTGATCG<br>GCGTGGGAGAGAAGAAGATCACCCACCACTGGCACCGCAGCGGCAGCACAATCGG<br>CAAGGCCTTTGAAGCCACAGTGCGGGGAGCCAAGAGAATGGCCGTGCTGGGAGAT<br>ACCGCCTGGGACTTTGGCTCTGTGGGCGGAGCCCTGAACTCTCTGGGCAAGGGAA<br>TCCACCAGATCTTCGGAGCCGCCTTTAAGAGCCTGTTCGGCGGCATGAGCTGGTT<br>CAGCCAGATCCTGATCGGCACCCTGCTCGTGTGGCTGGGCCTGAACACCAAGAAC<br>GGCAGCATCTCCCTGACCTGCCTGGCTCTGGGAGGCGTGCTGATCTTTCTGAGCA<br>CCGCCGTGTCTGCCTGATAATAGGCTGGAGCCTCGGTGGCCATGCTTCTTGCCCC<br>TTGGGCCTCCCCCCAGCCCCTCCTCCCCTTCCTGCACCCGTACCCCCGTGGTCTT<br>TGAATAAAGTCTGAGTGGGCGGC | |
| HuIgG$_k$ signal peptide_prME #2 (Brazil_ isolate_ ZikaSPH2015), ORF Sequence, NT | ATGGAAACCCCTGCCCAGCTGCTGTTCCTGCTGCTGCTGTGGCTGCCTGATACCA<br>CCGGCACCAGAAGAGGCAGCGCCTACTACATGTACCTGGACAGAAGCGACGCCGG<br>CGAGGCCATCAGCTTTCCAACCACCCTGGGCATGAACAAGTGCTACATCCAGATC<br>ATGGACCTGGGCCACATGTGCGACGCCACCATGAGCTACGAGTGCCCCATGCTGG<br>ACGAGGGCGTGGAACCCGACGATGTGGACTGCTGGTGCAACACCACCAGCACCTG<br>GGTGGTGTACGGCACCTGTCACCACAAGAAGGGCGAAGCCAGACGGTCCAGACGG<br>GCCGTGACACTGCCTAGCCACTCCACCAGAAAGCTGCAGACCCGGTCCCAGACCT<br>GGCTGGAAAGCAGAGAGTACACCAAGCACCTGATCCGGGTGGAAAACTGGATCTT<br>CCGGAACCCCGGCTTTGCCCTGGCCGCTGCTGCTATTGCTTGGCTGCTGGGCAGC<br>AGCACCTCCCAGAAAGTGATCTACCTCGTGATGATCCTGCTGATCGCCCCTGCCT<br>ACAGCATCCGGTGTATCGGCGTGTCCAACCGGGACTTCGTGGAAGGCATGAGCGG<br>CGGCACATGGGTGGACGTGGTGCTGGAACATGGCGGCTGCGTGACAGTGATGGCC<br>CAGGATAAGCCCGCCGTGGACATCGAGCTCGTGACCACCACCGTGTCCAATATGG<br>CCGAAGTGCGGAGCTACTGCTACGAGGCCAGCATCAGCGACATGGCCAGCGACAG<br>CAGATGCCCTACACAGGGCGAGGCCTACCTGGATAAGCAGTCCGACACCCAGTAC<br>GTGTGCAAGCGGACCCTGGTGGATAGAGGCTGGGGCAATGGCTGCGGCCTGTTTG<br>GCAAGGGCAGCCTCGTGACCTGCGCCAAGTTCGCCTGCAGCAAGAAGATGACCGG<br>CAAGAGCATCCAGCCCGAGAACCTGGAATACCGGATCATGCTGAGCGTGCACGGC<br>AGCCAGCACTCCGGCATGATCGTGAACGACACCGGCCACGAGACAGACGAGAACC<br>GGGCCAAGGTGGAAATCACCCCCAACAGCCCTAGAGCCGAGGCCACACTGGGCGG<br>CTTTGGATCTCTGGGCCTGGACTGCGAGCCTAGAACCGGCCTGGATTTCAGCGAC<br>CTGTACTACCTGACCATGAACAACAAGCACTGGCTGGTGCACAAAGAGTGGTTCC<br>ACGACATCCCCCTGCCCTGGCATGCCGGCGCTGATACAGGCACACCCCACTGGAA<br>CAACAAAGAGGCTCTGGTGGAATTCAAGGACGCCCACGCCAAGCGGCAGACCGTG<br>GTGGTGCTGGGATCTCAGGAAGGCGCCGTGCATACAGCTCTGGCTGGCGCCCTGG<br>AAGCCGAAATGGATGGCGCCAAAGGCAGACTGTCCAGCGGCCACCTGAAGTGCCG<br>GCTGAAGATGGACAAGCTGCGGCTGAAGGGCGTGTCCTACAGCCTGTGTACCGCC<br>GCCTTCACCTTCACCAAGATCCCCGCCGAGACACTGCACGGCACCGTGACTGTGG<br>AAGTGCAGTACGCCGGCACCGACGGCCCTTGTAAAGTGCCTGCTCAGATGGCCGT<br>GGATATGCAGACCCTGACCCCCGTGGGCAGACTGATCACCGCCAACCCTGTGATC<br>ACCGAGAGCACCGAGAACAGCAAGATGATGCTGGAACTGGACCCCCCCTTCGGCG<br>ACTCCTACATCGTGATCGGCGTGGGAGAGAAGAAGATCACCCACCACTGGCACCG<br>CAGCGGCAGCACAATCGGCAAGGCCTTTGAAGCCACAGTGCGGGGAGCCAAGAGA<br>ATGGCCGTGCTGGGAGATACCGCCTGGGACTTTGGCTCTGTGGGCGGAGCCCTGA<br>ACTCTCTGGGCAAGGGAATCCACCAGATCTTCGGAGCCGCCTTTAAGAGCCTGTT<br>CGGCGGCATGAGCTGGTTCAGCCAGATCCTGATCGGCACCCTGCTCGTGTGGCTG<br>GGCCTGAACACCAAGAACGGCAGCATCTCCCTGACCTGCCTGGCTCTGGGAGGCG<br>TGCTGATCTTTCTGAGCACCGCCGTGTCTGCC | 59 |
| HuIgG$_k$ signal peptide_prME #2 (Brazil_ isolate_ ZikaSPH2015), mRNA Sequence (T100 tail) | G*GGGAAATAAGAGAGAAAAGAAGAGTAAGAAGAAATATAAGAGCCACCATGGAA<br>ACCCCTGCCCAGCTGCTGTTCCTGCTGCTGCTGTGGCTGCCTGATACCACCGGCA<br>CCAGAAGAGGCAGCGCCTACTACATGTACCTGGACAGAAGCGACGCCGGCGAGGC<br>CATCAGCTTTCCAACCACCCTGGGCATGAACAAGTGCTACATCCAGATCATGGAC<br>CTGGGCCACATGTGCGACGCCACCATGAGCTACGAGTGCCCCATGCTGGACGAGG<br>GCGTGGAACCCGACGATGTGGACTGCTGGTGCAACACCACCAGCACCTGGGTGGT<br>GTACGGCACCTGTCACCACAAGAAGGGCGAAGCCAGACGGTCCAGACGGGCCGTG<br>ACACTGCCTAGCCACTCCACCAGAAAGCTGCAGACCCGGTCCCAGACCTGGCTGG<br>AAAGCAGAGAGTACACCAAGCACCTGATCCGGGTGGAAAACTGGATCTTCCGGAA<br>CCCCGGCTTTGCCCTGGCCGCTGCTGCTATTGCTTGGCTGCTGGGCAGCAGCACC<br>TCCCAGAAAGTGATCTACCTCGTGATGATCCTGCTGATCGCCCCTGCCTACAGCA<br>TCCGGTGTATCGGCGTGTCCAACCGGGACTTCGTGGAAGGCATGAGCGGCGGCAC<br>ATGGGTGGACGTGGTGCTGGAACATGGCGGCTGCGTGACAGTGATGGCCCAGGAT | 60 |

TABLE 31-continued

ZIKV Nucleic Acid Sequences

| Description | Sequence | SEQ ID NO: |
|---|---|---|
| | AAGCCCGCCGTGGACATCGAGCTCGTGACCACCACCGTGTCCAATATGGCCGAAG<br>TGCGGAGCTACTGCTACGAGGCCAGCATCAGCGACATGGCCAGCGACAGCAGATG<br>CCCTACACAGGGCGAGGCCTACCTGGATAAGCAGTCCGACACCCAGTACGTGTGC<br>AAGCGGACCCTGGTGGATAGAGGCTGGGGCAATGGCTGCGGCCTGTTTGGCAAGG<br>GCAGCCTCGTGACCTGCGCCAAGTTCGCCTGCAGCAAGAAGATGACCGGCAAGAG<br>CATCCAGCCCGAGAACCTGGAATACCGGATCATGCTGAGCGTGCACGGCAGCCAG<br>CACTCCGGCATGATCGTGAACGACACCGGCCACGAGACAGACGAGAACCGGGCCA<br>AGGTGGAAATCACCCCCAACAGCCCTAGAGCCGAGGCCACACTGGGCGGCTTTGG<br>ATCTCTGGGCCTGGACTGCGAGCCTAGAACCGGCCTGGATTTCAGCGACCTGTAC<br>TACCTGACCATGAACAACAAGCACTGGCTGGTGCACAAAGAGTGGTTCCACGACA<br>TCCCCCTGCCCTGGCATGCCGGCGCTGATACAGGCACACCCCACTGGAACAACAA<br>AGAGGCTCTGGTGGAATTCAAGGACGCCCACGCCAAGCGGCAGACCGTGGTGGTG<br>CTGGGATCTCAGGAAGGCGCCGTGCATACAGCTCTGGCTGGCGCCCTGGAAGCCG<br>AAATGGATGGCGCCAAAGGCAGACTGTCCAGCGGCCACCTGAAGTGCCGGCTGAA<br>GATGGACAAGCTGCGGCTGAAGGGCGTGTCCTACAGCCTGTGTACCGCCGCCTTC<br>ACCTTCACCAAGATCCCCGCCGAGACACTGCACGGCACCGTGACTGTGGAAGTGC<br>AGTACGCCGGCACCGACGGCCCTTGTAAAGTGCCTGCTCAGATGGCCGTGGATAT<br>GCAGACCCTGACCCCCGTGGGCAGACTGATCACCGCCAACCCTGTGATCACCGAG<br>AGCACCGAGAACAGCAAGATGATGCTGGAACTGGACCCCCCCTTCGGCGACTCCT<br>ACATCGTGATCGGCGTGGGAGAGAAGAAGATCACCCACCACTGGCACCGCAGCGG<br>CAGCACAATCGGCAAGGCCTTTGAAGCCACAGTGCGGGGAGCCAAGAGAATGGCC<br>GTGCTGGGAGATACCGCCTGGGACTTTGGCTCTGTGGGCGGAGCCCTGAACTCTC<br>TGGGCAAGGGAATCCACCAGATCTTCGGAGCCGCCTTTAAGAGCCTGTTCGGCGG<br>CATGAGCTGGTTCAGCCAGATCCTGATCGGCACCCTGCTCGTGTGGCTGGGCCTG<br>AACACCAAGAACGGCAGCATCTCCCTGACCTGCCTGGCTCTGGGAGGCGTGCTGA<br>TCTTTCTGAGCACCGCCGTGTCTGCCTGATAATAGGCTGGAGCCTCGGTGGCCAT<br>GCTTCTTGCCCCTTGGGCCTCCCCCCAGCCCCTCCTCCCCTTCCTGCACCCGTAC<br>CCCCGTGGTCTTTGAATAAAGTCTGAGTGGGCGGCAAAAAAAAAAAAAAAAAA<br>AAAAAAAAAAAAAAAAAAAAAAAAAAAAAAAAAAAAAAAAAAAAAAAAAAAA<br>AAAAAAAAAAAAAAAAAAAAAAATCTAG | |
| HuIgG$_k$ signal peptide_E (Brazil_ isolate_ ZikaSPH2015), Sequence, NT (5' UTR, ORF, 3' UTR) | TCAAGCTTTTGGACCCTCGTACAGAAGCTAATACGACTCACTATAGGGAAATAAG<br>AGAGAAAAGAAGAGTAAGAAGAAATATAAGAGCCACCATGGAAACCCCTGCCCAG<br>CTGCTGTTCCTGCTGCTGCTGTGGCTGCCTGACACCACCGGCATCAGATGCATCG<br>GCGTGTCCAACCGGGACTTCGTGGAAGGCATGAGCGGCGGCACATGGGTGGACGT<br>GGTGCTGGAACATGGCGGCTGCGTGACAGTGATGGCCCAGGATAAGCCCGCCGTG<br>GACATCGAGCTCGTGACCACCACCGTGTCCAATATGGCCGAAGTGCGGAGCTACT<br>GCTACGAGGCCAGCATCAGCGACATGGCCAGCGACAGCAGATGCCCTACACAGGG<br>CGAGGCCTACCTGGACAAGCAGAGCGACACCCAGTACGTGTGCAAGCGGACCCTG<br>GTGGATAGAGGCTGGGGCAATGGCTGCGGCCTGTTTGGCAAGGGCAGCCTCGTGA<br>CCTGCGCCAAGTTCGCCTGCAGCAAGAAGATGACCGGCAAGAGCATCCAGCCCGA<br>GAACCTGGAATACCGGATCATGCTGAGCGTGCACGGCAGCCAGCACTCCGGCATG<br>ATCGTGAACGACACCGGCCACGAGACAGACGAGAACCGGGCCAAGGTGGAAATCA<br>CCCCCAACAGCCCTAGAGCCGAGGCCACACTGGGCGGCTTTGGATCTCTGGGCCT<br>GGACTGCGAGCCTAGAACCGGCCTGGATTTCAGCGACCTGTACTACCTGACCATG<br>AACAACAAGCACTGGCTGGTGCACAAAGAGTGGTTCCACGACATCCCCCTGCCCT<br>GGCATGCCGGCGCTGATACAGGCACACCCCACTGGAACAACAAAGAGGCTCTGGT<br>GGAATTCAAGGACGCCCACGCCAAGCGGCAGACCGTGGTGGTGCTGGGATCTCAG<br>GAAGGCGCCGTGCATACAGCTCTGGCTGGCGCCCTGGAAGCCGAAATGGATGGCG<br>CCAAAGGCAGACTGAGCAGCGGCCACCTGAAGTGCCGGCTGAAGATGGACAAGCT<br>GCGGCTGAAGGGCGTGTCCTACAGCCTGTGTACCGCCGCCTTCACCTTCACCAAG<br>ATCCCCGCCGAGACACTGCACGGCACCGTGACTGTGGAAGTGCAGTACGCCGGCA<br>CCGACGGCCCTTGTAAAGTGCCTGCTCAGATGGCCGTGGATATGCAGACCCTGAC<br>CCCCGTGGGCAGGCTGATCACAGCCAACCCTGTGATCACCGAGAGCACCGAGAAC<br>AGCAAGATGATGCTGGAACTGGACCCCCCCTTCGGCGACTCCTACATCGTGATCG<br>GCGTGGGAGAGAAGAAGATCACCCACCACTGGCACAGAAGCGGCAGCACCATCGG<br>CAAGGCCTTTGAGGCTACAGTGCGGGGAGCCAAGAGAATGGCCGTGCTGGGAGAT<br>ACCGCCTGGGACTTTGGCTCTGTGGGCGGAGCCCTGAACTCTCTGGGCAAGGGAA<br>TCCACCAGATCTTCGGCGCTGCCTTCAAGAGCCTGTTCGGCGGCATGAGCTGGTT<br>CAGCCAGATCCTGATCGGCACCCTGCTCGTGTGGCTGGGCCTGAACACCAAGAAC<br>GGCAGCATCTCCCTGACCTGCCTGGCTCTGGGAGGCGTGCTGATCTTTCTGAGCA<br>CCGCCGTGTCTGCCTGATAATAGGCTGGAGCCTCGGTGGCCATGCTTCTTGCCCC<br>TTGGGCCTCCCCCCAGCCCCTCCTCCCCTTCCTGCACCCGTACCCCCGTGGTCTT<br>TGAATAAAGTCTGAGTGGGCGGC | 61 |
| HuIgG$_k$ signal peptide_E (Brazil_ isolate_ ZikaSPH2015), ORF Sequence, NT | ATGGAAACCCCTGCCCAGCTGCTGTTCCTGCTGCTGCTGTGGCTGCCTGACACCA<br>CCGGCATCAGATGCATCGGCGTGTCCAACCGGGACTTCGTGGAAGGCATGAGCGG<br>CGGCACATGGGTGGACGTGGTGCTGGAACATGGCGGCTGCGTGACAGTGATGGCC<br>CAGGATAAGCCCGCCGTGGACATCGAGCTCGTGACCACCACCGTGTCCAATATGG<br>CCGAAGTGCGGAGCTACTGCTACGAGGCCAGCATCAGCGACATGGCCAGCGACAG<br>CAGATGCCCTACACAGGGCGAGGCCTACCTGGACAAGCAGAGCGACACCCAGTAC<br>GTGTGCAAGCGGACCCTGGTGGATAGAGGCTGGGGCAATGGCTGCGGCCTGTTTG<br>GCAAGGGCAGCCTCGTGACCTGCGCCAAGTTCGCCTGCAGCAAGAAGATGACCGG<br>CAAGAGCATCCAGCCCGAGAACCTGGAATACCGGATCATGCTGAGCGTGCACGGC | 62 |

TABLE 31-continued

| ZIKV Nucleic Acid Sequences | | |
|---|---|---|
| Description | Sequence | SEQ ID NO: |
| | AGCCAGCACTCCGGCATGATCGTGAACGACACCGGCCACGAGACAGACGAGAACC<br>GGGCCAAGGTGGAAATCACCCCCAACAGCCCTAGAGCCGAGGCCACACTGGGCGG<br>CTTTGGATCTCTGGGCCTGGACTGCGAGCCTAGAACCGGCCTGGATTTCAGCGAC<br>CTGTACTACCTGACCATGAACAACAAGCACTGGCTGGTGCACAAAGAGTGGTTCC<br>ACGACATCCCCCTGCCCTGGCATGCCGGCGCTGATACAGGCACACCCCACTGGAA<br>CAACAAAGAGGCTCTGGTGGAATTCAAGGACGCCCACGCCAAGCGGCAGACCGTG<br>GTGGTGCTGGGATCTCAGGAAGGCGCCGTGCATACAGCTCTGGCTGGCGCCCTGG<br>AAGCCGAAATGGATGGCGCCAAAGGCAGACTGAGCAGCGGCCACCTGAAGTGCCG<br>GCTGAAGATGGACAAGCTGCGGCTGAAGGGCGTGTCCTACAGCCTGTGTACCGCC<br>GCCTTCACCTTCACCAAGATCCCCGCCGAGACACTGCACGGCACCGTGACTGTGG<br>AAGTGCAGTACGCCGGCACCGACGGCCCTTGTAAAGTGCCTGCTCAGATGGCCGT<br>GGATATGCAGACCCTGACCCCCGTGGGCAGGCTGATCACAGCCAACCCTGTGATC<br>ACCGAGAGCACCGAGAACAGCAAGATGATGCTGGAACTGGACCCCCCCTTCGGCG<br>ACTCCTACATCGTGATCGGCGTGGGAGAGAAGAAGATCACCCACCACTGGCACAG<br>AAGCGGCAGCACCATCGGCAAGGCCTTTGAGGCTACAGTGCGGGGAGCCAAGAGA<br>ATGGCCGTGCTGGGAGATACCGCCTGGGACTTTGGCTCTGTGGGCGGAGCCCTGA<br>ACTCTCTGGGCAAGGGAATCCACCAGATCTTCGGCGCTGCCTTCAAGAGCCTGTT<br>CGGCGGCATGAGCTGGTTCAGCCAGATCCTGATCGGCACCCTGCTCGTGTGGCTG<br>GGCCTGAACACCAAGAACGGCAGCATCTCCCTGACCTGCCTGGCTCTGGGAGGCG<br>TGCTGATCTTTCTGAGCACCGCCGTGTCTGCC | |
| $HuIgG_k$ signal peptide_E (Brazil_ isolate_ ZikaSPH2015), mRNA Sequence (T100 tail) | G*GGGAAATAAGAGAGAAAAGAAGAGTAAGAAGAAATATAAGAGCCACCATGGAA<br>ACCCCTGCCCAGCTGCTGTTCCTGCTGCTGCTGTGGCTGCCTGACACCACCGGCA<br>TCAGATGCATCGGCGTGTCCAACCGGGACTTCGTGGAAGGCATGAGCGGCGGCAC<br>ATGGGTGGACGTGGTGCTGGAACATGGCGGCTGCGTGACAGTGATGGCCCAGGAT<br>AAGCCCGCCGTGGACATCGAGCTCGTGACCACCACCGTGTCCAATATGGCCGAAG<br>TGCGGAGCTACTGCTACGAGGCCAGCATCAGCGACATGGCCAGCGACAGCAGATG<br>CCCTACACAGGGCGAGGCCTACCTGGACAAGCAGAGCGACACCCAGTACGTGTGC<br>AAGCGGACCCTGGTGGATAGAGGCTGGGGCAATGGCTGCGGCCTGTTTGGCAAGG<br>GCAGCCTCGTGACCTGCGCCAAGTTCGCCTGCAGCAAGAAGATGACCGGCAAGAG<br>CATCCAGCCCGAGAACCTGGAATACCGGATCATGCTGAGCGTGCACGGCAGCCAG<br>CACTCCGGCATGATCGTGAACGACACCGGCCACGAGACAGACGAGAACCGGGCCA<br>AGGTGGAAATCACCCCCAACAGCCCTAGAGCCGAGGCCACACTGGGCGGCTTTGG<br>ATCTCTGGGCCTGGACTGCGAGCCTAGAACCGGCCTGGATTTCAGCGACCTGTAC<br>TACCTGACCATGAACAACAAGCACTGGCTGGTGCACAAAGAGTGGTTCCACGACA<br>TCCCCCTGCCCTGGCATGCCGGCGCTGATACAGGCACACCCCACTGGAACAACAA<br>AGAGGCTCTGGTGGAATTCAAGGACGCCCACGCCAAGCGGCAGACCGTGGTGGTG<br>CTGGGATCTCAGGAAGGCGCCGTGCATACAGCTCTGGCTGGCGCCCTGGAAGCCG<br>AAATGGATGGCGCCAAAGGCAGACTGAGCAGCGGCCACCTGAAGTGCCGGCTGAA<br>GATGGACAAGCTGCGGCTGAAGGGCGTGTCCTACAGCCTGTGTACCGCCGCCTTC<br>ACCTTCACCAAGATCCCCGCCGAGACACTGCACGGCACCGTGACTGTGGAAGTGC<br>AGTACGCCGGCACCGACGGCCCTTGTAAAGTGCCTGCTCAGATGGCCGTGGATAT<br>GCAGACCCTGACCCCCGTGGGCAGGCTGATCACAGCCAACCCTGTGATCACCGAG<br>AGCACCGAGAACAGCAAGATGATGCTGGAACTGGACCCCCCCTTCGGCGACTCCT<br>ACATCGTGATCGGCGTGGGAGAGAAGAAGATCACCCACCACTGGCACAGAAGCGG<br>CAGCACCATCGGCAAGGCCTTTGAGGCTACAGTGCGGGGAGCCAAGAGAATGGCC<br>GTGCTGGGAGATACCGCCTGGGACTTTGGCTCTGTGGGCGGAGCCCTGAACTCTC<br>TGGGCAAGGGAATCCACCAGATCTTCGGCGCTGCCTTCAAGAGCCTGTTCGGCGG<br>CATGAGCTGGTTCAGCCAGATCCTGATCGGCACCCTGCTCGTGTGGCTGGGCCTG<br>AACACCAAGAACGGCAGCATCTCCCTGACCTGCCTGGCTCTGGGAGGCGTGCTGA<br>TCTTTCTGAGCACCGCCGTGTCTGCCTGATAATAGGCTGGAGCCTCGGTGGCCAT<br>GCTTCTTGCCCCTTGGGCCTCCCCCCAGCCCCTCCTCCCCTTCCTGCACCCGTAC<br>CCCCGTGGTCTTTGAATAAAGTCTGAGTGGGCGGCAAAAAAAAAAAAAAAAAAAA<br>AAAAAAAAAAAAAAAAAAAAAAAAAAAAAAAAAAAAAAAAAAAAAAAAAAAAAAA<br>AAAAAAAAAAAAAAAAAAAAAAAAATCTAG | 63 |
| Zika_RIO- U1_JEVsp Zika PRME Strain ascension id: ANG09399 with JEV PRM signal sequence (optimized) | ATGCTGGGCAGCAACAGCGGCCAGAGAGTGGTGTTCACCATCCTGCTGCTGCTGG<br>TGGCCCCTGCCTACAGCGCCGAAGTGACAAGAAGAGGCAGCGCCTACTACATGTA<br>CCTGGACCGGAACGATGCCGGCGAGGCCATCAGCTTTCCAACCACCCTGGGCATG<br>AACAAGTGCTACATCCAGATCATGGACCTGGGCCACATGTGCGACGCCACCATGA<br>GCTACGAGTGCCCCATGCTGGACGAGGGCGTGGAACCCGACGATGTGGACTGCTG<br>GTGCAATACCACCAGCACCTGGGTGGTGTACGGCACCTGTCACCACAAGAAGGGC<br>GAAGCCAGACGGTCCAGACGGGCCGTGACACTGCCTAGCCACAGCACCAGAAAGC<br>TGCAGACCCGGTCCCAGACCTGGCTGGAAAGCAGAGAGTACACCAAGCACCTGAT<br>CCGGGTGGAAAACTGGATCTTCCGGAACCCCGGCTTTGCCCTGGCTGCCGCTGCT<br>ATTGCTTGGCTGCTGGGCTCTAGCACCAGCCAGAAAGTGATCTACCTCGTGATGA<br>TCCTGCTGATCGCCCCAGCCTACTCCATCCGGTGTATCGGCGTGTCCAACCGGGA<br>CTTCGTGGAAGGCATGAGCGGCGGCACATGGGTGGACGTGGTGCTGGAACATGGC<br>GGCTGCGTGACAGTGATGGCCCAGGACAAGCCCACCGTGGACATCGAGCTCGTGA<br>CCACCACCGTGTCCAATATGGCCGAAGTGCGGAGCTACTGCTACGAGGCCAGCAT<br>CAGCGACATGGCCAGCGACAGCAGATGCCCTACACAGGGCGAGGCCTACCTGGAC<br>AAGCAGTCCGACACCCAGTACGTGTGCAAGCGGACCCTGGTGGACAGGGGCTGGG<br>GCAATGGCTGTGGCCTGTTTGGCAAGGGCAGCCTCGTGACCTGCGCCAAGTTCGC<br>CTGCAGCAAGAAGATGACCGGCAAGAGCATCCAGCCCGAGAACCTGGAATACCGG | 64 |

TABLE 31-continued

ZIKV Nucleic Acid Sequences

| Description | Sequence | SEQ ID NO: |
|---|---|---|
| | ATCATGCTGAGCGTGCACGGCTCCCAGCACAGCGGCATGATCGTGAACGACACCG<br>GCCACGAGACAGACGAGAACCGGGCCAAGGTGGAAATCACCCCCAACAGCCCTAG<br>AGCCGAGGCCACACTGGGCGGCTTTGGATCTCTGGGCCTGGACTGCGAGCCTAGA<br>ACCGGCCTGGATTTCAGCGACCTGTACTACCTGACCATGAACAACAAACACTGGC<br>TGGTGCACAAAGAGTGGTTCCACGACATCCCCCTGCCCTGGCATGCTGGCGCTGA<br>TACAGGCACCCCCCACTGGAACAACAAAGAGGCCCTGGTGGAATTCAAGGACGCC<br>CACGCCAAGCGGCAGACCGTGGTGGTGCTGGGATCTCAGGAAGGCGCCGTGCATA<br>CAGCTCTGGCTGGCGCCCTGGAAGCCGAAATGGATGGCGCCAAAGGCAGACTGAG<br>CAGCGGCCACCTGAAGTGCCGGCTGAAGATGGACAAGCTGCGGCTGAAGGGCGTG<br>TCCTACAGCCTGTGTACCGCCGCCTTCACCTTCACCAAGATCCCCGCCGAGACAC<br>TGCACGGCACCGTGACTGTGGAAGTGCAGTACGCCGGCACCGACGGCCCTTGTAA<br>AGTGCCTGCTCAGATGGCCGTGGATATGCAGACCCTGACCCCCGTGGGCAGGCTG<br>ATCACAGCCAACCCTGTGATCACCGAGAGCACCGAGAACAGCAAGATGATGCTGG<br>AACTGGACCCCCCCTTCGGCGACTCCTACATCGTGATCGGCGTGGGAGAGAAGAA<br>GATCACCCACCACTGGCACAGAAGCGGCAGCACCATCGGCAAGGCCTTTGAGGCT<br>ACAGTGCGGGGAGCCAAGAGAATGGCCGTGCTGGGCGATACCGCCTGGGATTTTG<br>GCTCTGTGGGCGGAGCCCTGAACAGCCTGGGAAAGGGCATCCACCAGATCTTCGG<br>AGCCGCCTTTAAGAGCCTGTTCGGCGGCATGAGCTGGTTCAGCCAGATCCTGATC<br>GGCACCCTGCTGATGTGGCTGGGCCTGAACACCAAGAACGGCAGCATCTCCCTGA<br>TGTGCCTGGCTCTGGGCGGCGTGCTGATCTTTCTGAGCACAGCCGTGTCCGCC | |
| Zika_RIO-<br>U1¬_VSVgSp<br>Zika PRME<br>Strain<br>ascension id:<br>ANG09399 with<br>VSV g protein<br>signal<br>sequence<br>(optimized) | ATGAAGTGCCTGCTGTACCTGGCCTTCCTGTTCATCGGCGTGAACTGCGCCGAAG<br>TGACCAGAAGAGGCAGCGCCTACTACATGTACCTGGACCGGAACGATGCCGGCGA<br>GGCCATCAGCTTTCCAACCACCCTGGGCATGAACAAGTGCTACATCCAGATCATG<br>GACCTGGGCCACATGTGCGACGCCACCATGAGCTACGAGTGCCCCATGCTGGACG<br>AGGGCGTGGAACCCGACGATGTGGACTGCTGGTGCAACACCACCAGCACCTGGGT<br>GGTGTACGGCACCTGTCACCACAAGAAGGGCGAAGCCAGACGGTCCAGACGGGCC<br>GTGACACTGCCTAGCCACAGCACCAGAAAGCTGCAGACCCGGTCCCAGACCTGGC<br>TGGAAAGCAGAGAGTACACCAAGCACCTGATCCGGGTGGAAAACTGGATCTTCCG<br>GAACCCCGGCTTTGCCCTGGCCGCTGCTGCTATTGCTTGGCTGCTGGGCAGCAGC<br>ACCTCCCAGAAAGTGATCTACCTCGTGATGATCCTGCTGATCGCCCCTGCCTACA<br>GCATCCGGTGTATCGGCGTGTCCAACCGGGACTTCGTGGAAGGCATGAGCGGCGG<br>CACATGGGTGGACGTGGTGCTGGAACATGGCGGCTGCGTGACAGTGATGGCCCAG<br>GACAAGCCCACCGTGGACATCGAGCTCGTGACCACCACCGTGTCCAATATGGCCG<br>AAGTGCGGAGCTACTGCTACGAGGCCAGCATCAGCGACATGGCCAGCGACAGCAG<br>ATGCCCTACACAGGGCGAGGCCTACCTGGACAAGCAGTCCGACACCCAGTACGTG<br>TGCAAGCGGACCCTGGTGGATAGAGGCTGGGGCAATGGCTGCGGCCTGTTTGGCA<br>AGGGCAGCCTCGTGACCTGTGCCAAGTTCGCCTGCAGCAAGAAGATGACCGGCAA<br>GAGCATCCAGCCCGAGAACCTGGAATACCGGATCATGCTGAGCGTGCACGGCAGC<br>CAGCACTCCGGCATGATCGTGAACGACACCGGCCACGAGACAGACGAGAACCGGG<br>CCAAGGTGGAAATCACCCCCAACAGCCCTAGAGCCGAGGCCACACTGGGCGGCTT<br>TGGATCTCTGGGCCTGGACTGCGAGCCTAGAACCGGCCTGGATTTCAGCGACCTG<br>TACTACCTGACCATGAACAACAAGCACTGGCTGGTGCACAAAGAGTGGTTCCACG<br>ACATCCCCCTGCCCTGGCATGCCGGCGCTGATACAGGCACACCCCACTGGAACAA<br>CAAAGAGGCTCTGGTGGAATTCAAGGACGCCCACGCCAAGCGGCAGACCGTGGTG<br>GTGCTGGGATCTCAGGAAGGCGCCGTGCATACAGCTCTGGCTGGCGCCCTGGAAG<br>CCGAAATGGATGGCGCCAAAGGCAGACTGTCCAGCGGCCACCTGAAGTGCAGACT<br>GAAGATGGACAAGCTGCGGCTGAAGGGCGTGTCCTACAGCCTGTGTACCGCCGCC<br>TTCACCTTCACCAAGATCCCCGCCGAGACACTGCACGGCACCGTGACTGTGGAAG<br>TGCAGTACGCCGGCACCGACGGCCCTTGTAAAGTGCCAGCTCAGATGGCCGTGGA<br>TATGCAGACCCTGACCCCCGTGGGCAGACTGATCACCGCCAACCCTGTGATCACC<br>GAGAGCACCGAGAACAGCAAGATGATGCTGGAACTGGACCCCCCCTTCGGCGACT<br>CCTACATCGTGATCGGCGTGGGAGAGAAGAAGATCACCCACCACTGGCACAGAAG<br>CGGCAGCACCATCGGCAAGGCCTTTGAGGCTACAGTGCGGGGAGCCAAGAGAATG<br>GCCGTGCTGGGAGATACCGCCTGGGACTTTGGCTCTGTGGGCGGAGCCCTGAACT<br>CTCTGGGCAAGGGAATCCACCAGATCTTCGGAGCCGCCTTTAAGAGCCTGTTCGG<br>CGGCATGAGCTGGTTCAGCCAGATCCTGATCGGCACCCTGCTGATGTGGCTGGGC<br>CTGAACACCAAGAACGGCAGCATCTCCCTGATGTGCCTGGCTCTGGGAGGCGTGC<br>TGATCTTCCTGAGCACAGCCGTGTCTGCC | 65 |
| ZIKA_PRME_<br>DSP_N154A<br>Zika PRME<br>Strain<br>ascension id:<br>ACD75819 with<br>IgE signal<br>peptide<br>(optimized) | ATGGACTGGACCTGGATCCTGTTCCTGGTGGCCGCTGCCACAAGAGTGCACAGCG<br>TGGAAGTGACCAGACGGGGCAGCGCCTACTACATGTACCTGGACAGAAGCGACGC<br>CGGCGAGGCCATCAGCTTTCCAACCACCCTGGGCATGAACAAGTGCTACATCCAG<br>ATCATGGACCTGGGCCACATGTGCGACGCCACCATGAGCTACGAGTGCCCCATGC<br>TGGACGAGGGCGTGGAACCCGACGATGTGGACTGCTGGTGCAACACCACCAGCAC<br>CTGGGTGGTGTACGGCACCTGTCACCACAAGAAGGGCGAAGCCAGACGGTCCAGA<br>CGGGCCGTGACACTGCCTAGCCACAGCACCAGAAAGCTGCAGACCCGGTCCCAGA<br>CCTGGCTGGAAAGCAGAGAGTACACCAAGCACCTGATCCGGGTGGAAAACTGGAT<br>CTTCCGGAACCCCGGCTTTGCCCTGGCTGCCGCTGCTATTGCTTGGCTGCTGGGC<br>AGCAGCACCTCCCAGAAAGTGATCTACCTCGTGATGATCCTGCTGATCGCCCCTG<br>CCTACAGCATCCGGTGTATCGGCGTGTCCAACCGGGACTTCGTGGAAGGCATGAG<br>CGGCGGCACATGGGTGGACGTGGTGCTGGAACATGGCGGCTGCGTGACAGTGATG<br>GCCCAGGATAAGCCCGCCGTGGACATCGAGCTCGTGACCACCACCGTGTCCAATA<br>TGGCCGAAGTGCGGAGCTACTGCTACGAGGCCAGCATCAGCGACATGGCCAGCGA | 66 |

TABLE 31-continued

| ZIKV Nucleic Acid Sequences | | |
|---|---|---|
| Description | Sequence | SEQ ID NO: |
| | CAGCAGATGCCCTACACAGGGCGAGGCCTACCTGGATAAGCAGTCCGACACCCAG<br>TACGTGTGCAAGCGGACCCTGGTGGATAGAGGCTGGGGCAATGGCTGCGGCCTGT<br>TTGGCAAGGGCAGCCTCGTGACCTGCGCCAAGTTCGCCTGCAGCAAGAAGATGAC<br>CGGCAAGAGCATCCAGCCCGAGAACCTGGAATACCGGATCATGCTGAGCGTGCAC<br>GGCTCCCAGCACAGCGGCATGATCGTGGCCGACACCGGCCACGAGACAGACGAGA<br>ACCGGGCCAAGGTGGAAATCACCCCCAACAGCCCTAGAGCCGAGGCCACACTGGG<br>CGGCTTTGGATCTCTGGGCCTGGACTGCGAGCCTAGAACCGGCCTGGATTTCAGC<br>GACCTGTACTACCTGACCATGAACAACAAGCACTGGCTGGTGCACAAAGAGTGGT<br>TCCACGACATCCCCCTGCCCTGGCATGCTGGCGCTGATACAGGCACCCCCCACTG<br>GAACAACAAAGAGGCTCTGGTGGAATTCAAGGACGCCCACGCCAAGCGGCAGACC<br>GTGGTGGTGCTGGGATCTCAGGAAGGCGCCGTGCATACAGCTCTGGCTGGCGCCC<br>TGGAAGCCGAAATGGATGGCGCCAAAGGCAGACTGTCCTCCGGCCACCTGAAGTG<br>CCGGCTGAAGATGGACAAGCTGCGGCTGAAGGGCGTGTCCTACAGCCTGTGTACC<br>GCCGCCTTCACCTTCACCAAGATCCCCGCCGAGACACTGCACGGCACCGTGACTG<br>TGGAAGTGCAGTACGCCGGCACCGACGGCCCTTGTAAAGTGCCTGCTCAGATGGC<br>CGTGGATATGCAGACCCTGACCCCCGTGGGCAGACTGATCACCGCCAACCCTGTG<br>ATCACCGAGAGCACCGAGAACAGCAAGATGATGCTGGAACTGGACCCCCCCTTCG<br>GCGACTCCTACATCGTGATCGGCGTGGGAGAGAAGAAGATCACCCACCACTGGCA<br>CAGATCCGGCAGCACCATCGGCAAGGCCTTTGAGGCTACAGTGCGGGGAGCCAAG<br>AGAATGGCCGTGCTGGGCGATACCGCCTGGGATTTTGGCTCTGTGGGCGGAGCCC<br>TGAACAGCCTGGGAAAGGGCATCCACCAGATCTTCGGCGCTGCCTTCAAGAGCCT<br>GTTCGGCGGCATGAGCTGGTTCAGCCAGATCCTGATCGGCACCCTGCTCGTGTGG<br>CTGGGCCTGAACACCAAGAACGGCAGCATCTCCCTGACCTGCCTGGCTCTGGGCG<br>GCGTGCTGATCTTTCTGAGCACAGCCGTGTCCGCC | |

TABLE 32

| ZIKV Amino Acid Sequences | | |
|---|---|---|
| Description | Sequence | SEQ ID NO: |
| FSM\|ACD75819 polyprotein | MKNPKEEIRRIRIVNMLKRGVARVSPFGGLKRLPAGLLLGHGPIRMVLAI<br>LAFLRFTAIKPSLGLINRWGSVGKKEAMEIIKKFKKDLAAMLRIINARKE<br>KKRRGTDTSVGIVGLLLTTAMAVEVTRRGSAYYMYLDRSDAGEAISFPTT<br>LGMNKCYIQIMDLGHMCDATMSYECPMLDEGVEPDDVDCWCNTTSTWVVY<br>GTCHHKKGEARRSRRAVTLPSHSTRKLQTRSQTWLESREYTKHLIRVENW<br>IFRNPGFALAAAAIAWLLGSSTSQKVIYLVMILLIAPAYSIRCIGVSNRD<br>FVEGMSGGTWVDVVLEHGGCVTVMAQDKPAVDIELVTTTVSNMAEVRSYC<br>YEASISDMASDSRCPTQGEAYLDKQSDTQYVCKRTLVDRGWGNGCGLFGK<br>GSLVTCAKFACSKKMTGKSIQPENLEYRIMLSVHGSQHSGMIVNDTGHET<br>DENRAKVEITPNSPRAEATLGGFGSLGLDCEPRTGLDFSDLYYLTMNNKH<br>WLVHKEWFHDIPLPWHAGADTGTPHWNNKEALVEFKDAHAKRQTVVVLGS<br>QEGAVHTALAGALEAEMDGAKGRLSSGHLKCRLKMDKLRLKGVSYSLCTA<br>AFTFTKIPAETLHGTVTVEVQYAGTDGPCKVPAQMAVDMQTLTPVGRLIT<br>ANPVITESTENSKMMLELDPPFGDSYIVIGVGEKKITHHWHRSGSTIGKA<br>FEATVRGAKRMAVLGDTAWDFGSVGGALNSLGKGIHQIFGAAFKSLFGGM<br>SWFSQILIGTLLVWLGLNTKNGSISLTCLALGGVLIFLSTAVSA | 67 |
| MR_766\|ABI54475 | MKNPKKKSGGFRIVNMLKRGVARVNPLGGLKRLPAGLLLGHGPIRMVLAI<br>LAFLRFTAIKPSLGLINRWGTVGKKEAMEIIKKFKKDLAAMLRIINARKE<br>RKRRGADTSIGIVGLLLTTAMAAEITRRGSAYYMYLDRSDAGKAISFATT<br>LGVNKCHVQIMDLGHMCDATMSYECPMLDEGVEPDDVDCWCNTTSTWVVY<br>GTCHHKKGEARRSRRAVTLPSHSTRKLQTRSQTWLESREYTKHLIKVENW<br>IFRNPGFTLVAVAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCSKKMTGKSIQPENLEYRIMLSVHGSQHSGMIVNDENRAK<br>VEVTPNSPRAEATLGGFGSLGLDCEPRTGLDFSDLYYLTMNNKHWLVHKE<br>WFHDIPLPWHAGADTGTPHWNNKEALVEFKDAHAKRQTVVVLGSQEGAVH<br>TALAGALEAEMDGAKGRLFSGHLKCRLKMDKLRLKGVSYSLCTAAFTFTK<br>VPAETLHGTVTVEVQYAGTDGPCKVPAQMAVDMQTLTPVGRLITANPVIT<br>ESTENSKMMLELDPPFGDSYIVIGVGDKKITHHWHRSGSTIGKAFEATVR<br>GAKRMAVLGDTAWDFGSVGGVFNSLGKGIHQIFGAAFKSLFGGMSWFSQI<br>LIGTLLVWLGLNTKNGSISLTCLALGGVMIFLSTAVSA | 68 |
| SM_6_V_1\|ABI54480 | MKNPKRAGSSRLVNMLRRGAARVIPPGGGLKRLPVGLLLGRGPIKMILAI<br>LAFLRFTAIKPSTGLINRWGKVGKKEAIKILTKFKADVGTMLRIINNRKT<br>KKRGVETGIVFLALLVSIVAVEVTKKGDTYYMFADKKDAGKVVTFETESG<br>PNRCSIQAMDIGHMCPATMSYECPVLEPQYEPEDVDCWCNSTAAWIVYGT | 69 |

TABLE 32-continued

| ZIKV Amino Acid Sequences | | |
|---|---|---|
| Description | Sequence | SEQ ID NO: |
| | CTHKTTGETRRSRRSITLPSHASQKLETRSSTWLESREYSKYLIKVENWI<br>LRNPGYALVAAVIGWTLGSSRSQKIIFVTLLMLVAPAYSIRCIGIGNRDF<br>IEGMSGGTWVDIVLEHGGCVTVMSNDKPTLDFELVTTTASNMAEVRSYCY<br>EANISEMASDSRCPTQGEAYLDKMADSQFVCKRGYVDRGWGNGCGLFGKG<br>SIVTCAKFTCVKKLTGKSIQPENLEYRVLVSVHASQHGGMINNDTNHQHD<br>KENRARIDITASAPRVEVELGSFGSFSMECEPRSGLNEGDLYYLTMNNKH<br>WLVNRDWFHDLSLPWHTGATSNNHHWNNKEALVEFREAHAKKQTAVVLGS<br>QEGAVHAALAGALEAESDGHKATIYSGHLKCRLKLDKLRLKGMSYALCTG<br>AFTFARTPSETIHGTATVELQYAGEDGPCKVPIVITSDTNSMASTGRLIT<br>ANPVVTESGANSKMMVEIDPPFGDSYTIVGTGTTKITHHWHRAGSSIGRA<br>FEATMRGAKRMAVLGDTAWDFGSVGGMENSVGKFVHQVFGSAFKALFGGM<br>SWFTQLLIGFLLIWMGLNARGGTVAMSFMGIGAMLIFLATSVSG | |
| MR_766\|<br>AAV34151 | MKNPKEEIRRIRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIIGLLLTTAMAAEITRRGSAYYMYLDRSDAGKAISFATT<br>LGVNKCHVQIMDLGHMCDATMSYECPMLDEGVEPDDVDCWCNTTSTWVVY<br>GTCHHKKGEARRSRRAVTLPSHSTRKLQTRSQTWLESREYTKHLIKVENW<br>IFRNPGFALVAVAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCSKKMTGKSIQPENLEYRIMLSVHGSQHSGMIGYETDEDR<br>AKVEVTPNSPRAEATLGGEGSLGLDCEPRTGLDFSDLYYLTMNNKHWLVH<br>KEWFHDIPLPWHAGADTGTPHWNNKEALVEFKDAHAKRQTVVVLGSQEGA<br>VHTALAGALEAEMDGAKGRLFSGHLKCRLKMDKLRLKGVSYSLCTAAFTF<br>TKVPAETLHGTVTVEVQYAGTDGPCKIPVQMAVDMQTLTPVGRLITANPV<br>ITESTENSKMMLELDPPFGDSYIVIGVGDKKITHHWHRSGSTIGKAFEAT<br>VRGAKRMAVLGDTAWDFGSVGGVFNSLGKGIHQIFGAAFKSLFGGMSWFS<br>QILIGTLLVWLGLNTKNGSISLTCLALGGVMIFLSTAVSA | 70 |
| MR_766\|<br>YP_002790881 | MKNPKEEIRRIRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIIGLLLTTAMAAEITRRGSAYYMYLDRSDAGKAISFATT<br>LGVNKCHVQIMDLGHMCDATMSYECPMLDEGVEPDDVDCWCNTTSTWVVY<br>GTCHHKKGEARRSRRAVTLPSHSTRKLQTRSQTWLESREYTKHLIKVENW<br>IFRNPGFALVAVAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCKKMTGKSIQPENLEYRIMLSVHGSQHSGMIGYETDEDRA<br>KVEVTPNSPRAEATLGGEGSLGLDCEPRTGLDFSDLYYLTMNNKHWLVHK<br>EWFHDIPLPWHAGADTGTPHWNNKEALVEFKDAHAKRQTVVVLGSQEGAV<br>HTALAGALEAEMDGAKGRLFSGHLKCRLKMDKLRLKGVSYSLCTAAFTFT<br>KVPAETLHGTVTVEVQYAGTDGPCKIPVQMAVDMQTLTPVGRLITANPVI<br>TESTENSKMMLELDPPFGDSYIVIGVGDKKITHHWHRSGSTIGKAFEATV<br>RGAKRMAVLGDTAWDFGSVGGVFNSLGKGIHQIFGAAFKSLFGGMSWFSQ<br>ILIGTLLVWLGLNTKNGSISLTCLALGGVMIFLSTAVSA | 71 |
| ARB7701\|<br>AHF49785 | MKNPKKKSGGFRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIIGLLLTTAMAAEITRRGSAYYMYLDRSDAGKAISFATN<br>LGVNKCHVQIMDLGHMCDATMSYECPMLDEGVEPDDVDCWCNTTSTWVVY<br>GTCHHKKGEARRSRRAVTLPSHSTRKLQTRSQTWLESREYTKHLIKVENW<br>IFRNPGFALAAVAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCSKKMTGKSIQPENLEYRIMLSVHGSQHSGMIVNDIGHET<br>DENRAKVEVTPNSPRAEATLGGEGSLGLDCEPRTGLDFSDLYYLTMNNKH<br>WLVHKEWFHDIPLPWHAGADTGTPHWNNKEALVEFKDAHAKRQTVVVLGS<br>QEGAVHTALAGALEAEMDGAKGRLFSGHLKCRLKMDKLRLKGVSYSLCTA<br>AFTFTKVPAETLHGTVTVEVQYAGTDGPCKVPAQMAVDMQTLTPVGRLIT<br>ANPVITESTENSKMMLELDPPFGDSYIVIGVGDKKITHHWHRSGSTIGKA<br>FEATVRGAKRMAVLGDTAWDFGSVGGVFNSLGKGVHQIFGAAFKSLFGGM<br>SWFSQILIGTLLVWLGLNTKNGSISLTCLALGGVMIFLSTAVSA | 72 |
| ARB15076\|<br>AHF49784 | MKNPKKKSGGFRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIIGLLLTTAMAAEITRRGSAYYMYLDRSDAGKAISFATN<br>LGVNKCHVQIMDLGHMCDATMSYECPMLDEGVEPDDVDCWCNTTSTWVVY<br>GTCHHKKGEARRSRRAVTLPSHSTRKLQTRSQTWLESREYTKHLIKVENW<br>IFRNPGFALAAVAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCSKKMTGKSIQPENLEYRIMLSVHGSQHSGMIVNDENRAK<br>VEVTPNSPRAEATLGGEGSLGLDCEPRTGLDFSDLYYLTMNNKHWLVHKE | 73 |

TABLE 32-continued

ZIKV Amino Acid Sequences

<table>
<tr><th>Description</th><th>Sequence</th><th>SEQ ID NO:</th></tr>
<tr><td></td><td>WFHDIPLPWHAGADTGTPHWNNKEALVEFKDAHAKRQTVVVLGSQEGAVH<br>TALAGALEAEMDGAKGRLFSGHLKCRLKMDKLRLKGVSYSLCTAAFTFTK<br>VPAETLHGTVTVEVQYAGTDGPCKVPAQMAVDMQTLTPVGRLITANPVIT<br>ESTENSKMMLELDPPFGDSYIVIGVGDKKITHHWHRSGSTIGKAFEATVR<br>GAKRMAVLGDTAWDFGSVGGVFNSLGKGIHQIFGAAFKSLFGGMSWFSQI<br>LIGTLLVWLGLNTKNGSISLTCLALGGVMIFLSTAVSA</td><td></td></tr>
<tr><td>ARB13565|<br>AHF49783</td><td>MKNPKKKSGGFRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIIGLLLTTAMAAEITRRGSAYYMYLDRSDAGKAISFATN<br>LGVNKCHVQIMDLGHMCDATMSYECPMLDEGVEPDDVDCWCNTTSTWVVY<br>GTCHHKKGEARRSRRAVTLPSHSTRKLQTRSQTWLESREYTKHLIKVENW<br>IFRNPGFALAAVAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCSKKMTGKSIQPENLEYRIMLSVHGSQHSGMIVNDIGHET<br>DENRAKVEVTPNSPRAEATLGGEGSLGLDCEPRTGLDFSDLYYLTMNNKH<br>WLVHKEWFHDIPLPWHAGADTGTPHWNNKEALVEFKDAHAKRQTVVVLGS<br>QEGAVHTALAGALEAEMDGAKGRLFSGHLKCRLKMDKLRLKGVSYSLCTA<br>AFTFTKVPAETLHGTVTVEVQYAGTDGPCKVPAQMAVDMQTLTPVGRLIT<br>ANPVITESTENSKMMLELDPPFGDSYIVIGVGDKKITHHWHRSGSTIGKA<br>FEATVRGAKRMAVLGDTAWDFGSVGGVFNSLGKGVHQIFGAAFKSLFGGM<br>SWFSQILIGTLLVWLGLNTKNGSISLTCLALGGVMIFLSTAVSA</td><td>74</td></tr>
<tr><td>ArB1362|<br>AHL43500</td><td>MKNPKKKSGGFRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIIGLLLTTAMAAEITRRGSAYYMYLDRSDAGKAISFATT<br>LGVNKCHVQIMDLGHMCDATMSYECPMLDEGVEPDDVDCWCNTTSTWVVY<br>GTCHHKKGEARRSRRAVTLPSHSTRKLQTRSQTWLESREYTKHLIKVENW<br>IFRNPGFALAAVAIAWLLGSSTSQKVIYLIMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCSKKMTGKSIQPENLEYRIMLSVHGSQHSGMIVNDXXXXX<br>XXNRAEVEVTPNSPRAEATLGGEGSLGLDCEPRTGLDFSDLYYLTMNNKH<br>WLVHKEWFHDIPLPWHAGADTGTPHWNNKEALVEFKDAHAKRQTVVVLGS<br>QEGAVHTALAGALEAEMDGAKGRLFSGHLKCRLKMDKLRLKGVSYSLCTA<br>AFTFTKVPAETLHGTVTVEVQYAGTDGPCKVPAQMAVDMQTLTPVGRLIT<br>ANPVITESTENSKMMLELDPPFGDSYIVIGVGDKKITHHWHRSGSTIGKA<br>FEATVRGAKRMAVLGDTAWDFGSVGGVFNSLGKGIHQIFGAAFKSLFGGM<br>SWFSQILIGTLLVWLGLNTKNGSISLTCLALGGVMIFLSTAVSA</td><td>75</td></tr>
<tr><td>ArD7117|<br>AHL43501</td><td>MKNPKKRSGGFRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIVGLLLTTAMAAEITRRGSAYYMYLDRSDAGKAISFATT<br>LGVNKCHVQIMDLGHMCDATMSYECPMLDEGVEPDDVDCWCNTTSTWVVY<br>GTCQHKKGEARRSRRAVTLPSHSTRKLQTRSQTWLESREYTKHLIKVENW<br>IFRNPGFALVAVAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCSKKMTGKSIQPENLEYRIMLSVHGSQHSGMIVNDIGHET<br>DENRAKVEVTPNSPRAEATLGGEGSLGLDCEPRTGLDFSDLYYLTMNNKH<br>WLVHKEWFHDIPLPWHAGADTGTPHWNNKEALVEFKDAHAKRQTVVVLGS<br>QEGAVHTALAGALEAEMDGAKGRLFSGHLKCRLKMDKLRLKGVSYSLCTA<br>VCTAAKVPAETLHGTVTVEVQYAGTDGPCKVPAQMAVDMQTLTPVGRLIT<br>ANPVITESTENSKMMLELDPPFGDSYIVIGVGDKKITHHWHRSGSTIGKA<br>FEATVRGAKRMAVLGDTAWDFGSVGGVFNSLGKGIHQIFGAAFKSLFGGM<br>SWFSQILIGTLLVWLGLNTKNGSISLTCLALGGVMIFLSTAVSA</td><td>76</td></tr>
<tr><td>ArD157995|<br>AHL43503</td><td>MKNPKKKSGRFRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIIGLLLTTAMAAEITRRGSAYYMYLDRSDAGKAISFATT<br>LGVNKCHVQIMDLGHMCDATMSYECPMLDEGVEPDDVDCWCNTTSTWVVY<br>GTCHHKKGETRRSRRSVSLRYHYTRKLQTRSQTWLESREYKKHLIMVENW<br>IFRNPGFAIVSVAITWLMGSLTSQKVIYLVMIVLIVPAYSISCIGVSNRD<br>LVEGMSGGTWVDVVLEHGGCVTEMAQDKPTVDIELVTMTVSNMAEVRSYC<br>YEASLSDMASASRCPTQGEPSLDKQSDTQSVCKRTLGDRGWGNGCGIFGK<br>GSLVTCSKFTCCKKMPGKSIQPENLEYRIMLPVHGSQHSGMIVNDIGHET<br>DENRAKVEVTPNSPRAEATLGGEGSLGLDCEPRTGLDFSDLYYLTMNNKH<br>WLVHKEWFHDIPLPWHAGADTGTPHWNNKEALVEFKDAHAKRQTVVVLGS<br>QEGAVHTALAGALEAEMDGAKGRLFSGHLKCRLKMDKLRLKGVSYSLCTA<br>AFTFTKVPAETLHGTVTVEVQSAGTDGPCKVPAQMAVDMQTLTPVGRLIT<br>ANPVITESTENSKMMLELDPPFGDSYIVIGVGDKKITHHWHRSGSTIGKA<br>FEATVRGAKRMAVLGDTAWDFGSVGGVFNSLGKGIHQIFGAAFKSLFGGM<br>SWFSQILIGTLLVWLGLNTKNGSISLTCLALGGVMIFLSTAVSA</td><td>77</td></tr>
</table>

TABLE 32-continued

ZIKV Amino Acid Sequences

| Description | Sequence | SEQ ID NO: |
| --- | --- | --- |
| ArD128000\|<br>AHL43502 | MKNPKRKSGGFRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIIGLLLTTAMAAEITRRGSAYYMYLDRSDAGKAISFATT<br>LGVNKCHVQIMDLGHMCDATMSYECPMLDEGVEPDDVDCWCNTTSTWVVY<br>GTCHHKKGEARRSRRAVTLPSHSTRKLQTRSQTWLESREYTKHLIKVENW<br>IFRNPGFALAAVAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCSKKMTGKSIQPENLEYRIMLSVHGSQHSGMXXXXXGHET<br>DENRAKVEVTPNSPRAEATLGGEGSLGLDCEPRTGLDFSDLYYLTMNNKH<br>RLVRKEWFHDIPLPWHAGADTGTPHWNNKEALVEFKDAHAKRQTVVVLGS<br>QEGAVHTALAGALEAEMDGAKGRLFSGHLKCRLKMDKLRLKGVSYSLCTA<br>AFTFTKVPAETLHGTVTVEVQYAGTDGPCKVPAQMAVDMQTLTPVGRLIT<br>ANPVITESTENSKMMLELDPPFGDSYIVIGVGDKKITHHWLKKGSSIGKA<br>FEATVRGAKRMAVLGDTAWDFGSVGGVFNSLGKGVHQIFGAAFKSLFGGM<br>SWFSQILIGTLLVWLGLNTKNGSISLTCLALGGVMIFLSTAVSA | 78 |
| ArD158084\|<br>AHL43504 | MKNPKKKSGGFRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIIGLLLTTAMAAEITRRGSAYYMYLDRSDAGKAISFATT<br>LGVNKCHVQIMDLGHMCDATMSYECPMLDEGVEPDDVDCWCNTTSTWVVY<br>GTCHHKKGEARRSRRAVTLPSHSTRKLQTRSQTWLESREYTKHLIKVENW<br>IFRNPGFALVAVAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCSKKMTGKSIQPENLEYRIMLSVHGSQHSGMIVNDIGHET<br>DENRAKVEVTPNSPRAEATLGGEGSLGLDCEPRTGLDFSDLYYLTMNNKH<br>WLVHKEWFHDIPLPWHAGADTGTPHWNNKEALVEFKDAHAKRQTVVVLGS<br>QEGAVHTALAGALEAEMDGAKGRLFSGHLKCRLKMDKLRLKGVSYSLCTA<br>AFTFTKVPAETLHGTVTVEVQYAGTDGPCKVPAQMAVDMQTLTPVGRLIT<br>ANPVITESTENSKMMLELDPPFGDSYIVIGVGDKKITHHWHRSGSTIGKA<br>FEATVRGAKRMAVLGDTAWDFGSVGGVFNSLGKGIHQIFGAAFKSLFGGM<br>SWFSQILIGTLLVWLGLNTKNGSISLTCLALGGVMIFLSTAVSA | 79 |
| H/PF/2013\|<br>AHZ13508 | MKNPKKKSGGFRIVNMLKRGVARVSPEGGLKRLPAGLLLGHGPIRMVLAI<br>LAFLRFTAIKPSLGLINRWGSVGKKEAMEIIKKFKKDLAAMLRIINARKE<br>KKRRGADTSVGIVGLLLTTAMAAEVTRRGSAYYMYLDRNDAGEAISFPTT<br>LGMNKCYIQIMDLGHMCDATMSYECPMLDEGVEPDDVDCWCNTTSTWVVY<br>GTCHHKKGEARRSRRAVTLPSHSTRKLQTRSQTWLESREYTKHLIRVENW<br>IFRNPGFALAAAAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFACSKKMTGKSIQPENLEYRIMLSVHGSQHSGMIVNDTGHET<br>DENRAKVEITPNSPRAEATLGGEGSLGLDCEPRTGLDFSDLYYLTMNNKH<br>WLVHKEWFHDIPLPWHAGADTGTPHWNNKEALVEFKDAHAKRQTVVVLGS<br>QEGAVHTALAGALEAEMDGAKGRLSSGHLKCRLKMDKLRLKGVSYSLCTA<br>AFTFTKIPAETLHGTVTVEVQYAGTDGPCKVPAQMAVDMQTLTPVGRLIT<br>ANPVITESTENSKMMLELDPPFGDSYIVIGVGEKKITHHWHRSGSTIGKA<br>FEATVRGAKRMAVLGDTAWDFGSVGGALNSLGKGIHQIFGAAFKSLFGGM<br>SWFSQILIGTLLMWLGLNTKNGSISLMCLALGGVLIFLSTAVSA | 80 |
| MR766_NIID\|<br>BAP47441 | MKNPKKKSGGFRIVNMLKRGVARVNPLGGLKRLPAGLLLGHGPIRMVLAI<br>LAFLRFTAIKPSLGLINRWGSVGKKEAMEIIKKFKKDLAAMLRIINARKE<br>RKRRGADTSIGIIGLLLTTAMAAEITRRGSAYYMYLDRSDAGKAISFATT<br>LGVNKCHVQIMDLGHMCDATMSYECPMLDEGVEPDDVDCWCNTTSTWVVY<br>GTCHHKKGEARRSRRAVTLPSHSTRKLQTRSQTWLESREYTKHLIKVENW<br>IFRNPGFALVAVAIAWLLGSSTSQKVIYLVMILLIAPAYSIRCIGVSNRD<br>FVEGMSGGTWVDVVLEHGGCVTVMAQDKPTVDIELVTTTVSNMAEVRSYC<br>YEASISDMASDSRCPTQGEAYLDKQSDTQYVCKRTLVDRGWGNGCGLFGK<br>GSLVTCAKFTCSKKMTGKSIQPENLEYRIMLSVHGSQHSGMTVNDIGYET<br>DENRAKVEVTPNSPRAEATLGGEGSLGLDCEPRTGLDFSDLYYLTMNNKH<br>WLVHKEWFHDIPLPWHAGADTGTPHWNNKEALVEFKDAHAKRQTVVVLGS<br>QEGAVHTALAGALEAEMDGAKGKLFSGHLKCRLKMDKLRLKGVSYSLCTA<br>AFTFTKVPAETLHGTVTVEVQYAGTDGPCKIPVQMAVDMQTLTPVGRLIT<br>ANPVITESTENSKMMLELDPPFGDSYIVIGVGDKKITHHWHRSGSTIGKA<br>FEATVRGAKRMAVLGDTAWDFGSVGGVFNSLGKGIHQIFGAAFKSLFGGM<br>SWFSQILIGTLLVWLGLNTKNGSISLTCLALGGVMIFLSTAVSA | 81 |
| prME<br>ABI54480_<br>SouthAfrica | VEVTKKGDTYYMFADKKDAGKVVTFETESGPNRCSIQAMDIGHMCPATMS<br>YECPVLEPQYEPEDVDCWCNSTAAWIVYGTCTHKTTGETRRSRRSITLPS<br>HASQKLETRSSTWLESREYSKYLIKVENWILRNPGYALVAAVIGWTLGSS<br>RSQKIIFVTLLMLVAPAYSIRCIGIGNRDFIEGMSGGTWVDIVLEHGGCV<br>TVMSNDKPTLDFELVTTTASNMAEVRSYCYEANISEMASDSRCPTQGEAY | 82 |

TABLE 32-continued

ZIKV Amino Acid Sequences

| Description | Sequence | SEQ ID NO: |
| --- | --- | --- |
| | LDKMADSQFVCKRGYVDRGWGNGCGLFGKGSIVTCAKFTCVKKLTGKSIQ<br>PENLEYRVLVSVHASQHGGMINNDTNHQHDKENRARIDITASAPRVEVEL<br>GSFGSFSMECEPRSGLNEGDLYYLTMNNKHWLVNRDWFHDLSLPWHTGAT<br>SNNHHWNNKEALVEFREAHAKKQTAVVLGSQEGAVHAALAGALEAESDGH<br>KATIYSGHLKCRLKLDKLRLKGMSYALCTGAFTFARTPSETIHGTATVEL<br>QYAGEDGPCKVPIVITSDTNSMASTGRLITANPVVTESGANSKMMVEIDP<br>PFGDSYTIVGTGTTKITHHWHRAGSSIGRAFEATMRGAKRMAVLGDTAWD<br>FGSVGGMENSVGKFVHQVFGSAFKALFGGMSWFTQLLIGFLLIWMGLNAR<br>GGTVAMSFMGIGAMLIFLATSVSG | |
| prME<br>AAV34151_<br>Uganda_NHP | AEITRRGSAYYMYLDRSDAGKAISFATTLGVNKCHVQIMDLGHMCDATMS<br>YECPMLDEGVEPDDVDCWCNTTSTWVVYGTCHHKKGEARRSRRAVTLPSH<br>STRKLQTRSQTWLESREYTKHLIKVENWIFRNPGFALVAVAIAWLLGSST<br>SQKVIYLVMILLIAPAYSIRCIGVSNRDFVEGMSGGTWVDVVLEHGGCVT<br>VMAQDKPTVDIELVTTTVSNMAEVRSYCYEASISDMASDSRCPTQGEAYL<br>DKQSDTQYVCKRTLVDRGWGNGCGLFGKGSLVTCAKFTCSKKMTGKSIQP<br>ENLEYRIMLSVHGSQHSGMIGYETDEDRAKVEVTPNSPRAEATLGGFGSL<br>GLDCEPRTGLDFSDLYYLTMNNKHWLVHKEWFHDIPLPWHAGADTGTPHW<br>NNKEALVEFKDAHAKRQTVVVLGSQEGAVHTALAGALEAEMDGAKGRLFS<br>GHLKCRLKMDKLRLKGVSYSLCTAAFTFTKVPAETLHGTVTVEVQYAGTD<br>GPCKIPVQMAVDMQTLTPVGRLITANPVITESTENSKMMLELDPPFGDSY<br>IVIGVGDKKITHHWHRSGSTIGKAFEATVRGAKRMAVLGDTAWDFGSVGG<br>VFNSLGKGIHQIFGAAFKSLFGGMSWFSQILIGTLLVWLGLNTKNGSISL<br>TCLALGGVMIFLSTAVSA | 83 |
| prME<br>AHZ13508_<br>FrenchPoly_2013 | AEVTRRGSAYYMYLDRNDAGEAISEPTTLGMNKCYIQIMDLGHMCDATMS<br>YECPMLDEGVEPDDVDCWCNTTSTWVVYGTCHHKKGEARRSRRAVTLPSH<br>STRKLQTRSQTWLESREYTKHLIRVENWIFRNPGFALAAAAIAWLLGSST<br>SQKVIYLVMILLIAPAYSIRCIGVSNRDFVEGMSGGTWVDVVLEHGGCVT<br>VMAQDKPTVDIELVTTTVSNMAEVRSYCYEASISDMASDSRCPTQGEAYL<br>DKQSDTQYVCKRTLVDRGWGNGCGLFGKGSLVTCAKFACSKKMTGKSIQP<br>ENLEYRIMLSVHGSQHSGMIVNDTGHETDENRAKVEITPNSPRAEATLGG<br>FGSLGLDCEPRTGLDFSDLYYLTMNNKHWLVHKEWFHDIPLPWHAGADTG<br>TPHWNNKEALVEFKDAHAKRQTVVVLGSQEGAVHTALAGALEAEMDGAKG<br>RLSSGHLKCRLKMDKLRLKGVSYSLCTAAFTFTKIPAETLHGTVTVEVQY<br>AGTDGPCKVPAQMAVDMQTLTPVGRLITANPVITESTENSKMMLELDPPF<br>GDSYIVIGVGEKKITHHWHRSGSTIGKAFEATVRGAKRMAVLGDTAWDFG<br>SVGGALNSLGKGIHQIFGAAFKSLFGGMSWFSQILIGTLLMWLGLNTKNG<br>SISLMCLALGGVLIFLSTAVSA | 84 |
| prME<br>gAHL43504 | AEITRRGSAYYMYLDRSDAGKAISFATTLGVNKCHVQIMDLGHMCDATMS<br>YECPMLDEGVEPDDVDCWCNTTSTWVVYGTCHHKKGEARRSRRAVTLPSH<br>STRKLQTRSQTWLESREYTKHLIKVENWIFRNPGFALVAVAIAWLLGSST<br>SQKVIYLVMILLIAPAYSIRCIGVSNRDFVEGMSGGTWVDVVLEHGGCVT<br>VMAQDKPTVDIELVTTTVSNMAEVRSYCYEASISDMASDSRCPTQGEAYL<br>DKQSDTQYVCKRTLVDRGWGNGCGLFGKGSLVTCAKFTCSKKMTGKSIQP<br>ENLEYRIMLSVHGSQHSGMIVNDIGHETDENRAKVEVTPNSPRAEATLGG<br>FGSLGLDCEPRTGLDFSDLYYLTMNNKHWLVHKEWFHDIPLPWHAGADTG<br>TPHWNNKEALVEFKDAHAKRQTVVVLGSQEGAVHTALAGALEAEMDGAKG<br>RLFSGHLKCRLKMDKLRLKGVSYSLCTAAFTFTKVPAETLHGTVTVEVQY<br>AGTDGPCKVPAQMAVDMQTLTPVGRLITANPVITESTENSKMMLELDPPF<br>GDSYIVIGVGDKKITHHWHRSGSTIGKAFEATVRGAKRMAVLGDTAWDFG<br>SVGGVFNSLGKGIHQIFGAAFKSLFGGMSWFSQILIGTLLVWLGLNTKNG<br>SISLTCLALGGVMIFLSTAVSA | 85 |
| prME<br>AHL43503 | AEITRRGSAYYMYLDRSDAGKAISFATTLGVNKCHVQIMDLGHMCDATMS<br>YECPMLDEGVEPDDVDCWCNTTSTWVVYGTCHHKKGETRRSRRSVSLRYH<br>YTRKLQTRSQTWLESREYKKHLIMVENWIFRNPGFAIVSVAITWLMGSLT<br>SQKVIYLVMIVLIVPAYSISCIGVSNRDLVEGMSGGTWVDVVLEHGGCVT<br>EMAQDKPTVDIELVTMTVSNMAEVRSYCYEASLSDMASASRCPTQGEPSL<br>DKQSDTQSVCKRTLGDRGWGNGCGIFGKGSLVTCSKFTCCKKMPGKSIQP<br>ENLEYRIMLPVHGSQHSGMIVNDIGHETDENRAKVEVTPNSPRAEATLGG<br>FGSLGLDCEPRTGLDFSDLYYLTMNNKHWLVHKEWFHDIPLPWHAGADTG<br>TPHWNNKEALVEFKDAHAKRQTVVVLGSQEGAVHTALAGALEAEMDGAKG<br>RLFSGHLKCRLKMDKLRLKGVSYSLCTAAFTFTKVPAETLHGTVTVEVQS<br>AGTDGPCKVPAQMAVDMQTLTPVGRLITANPVITESTENSKMMLELDPPF<br>GDSYIVIGVGDKKITHHWHRSGSTIGKAFEATVRGAKRMAVLGDTAWDFG<br>SVGGVFNSLGKGIHQIFGAAFKSLFGGMSWFSQILIGTLLVWLGLNTKNG<br>SISLTCLALGGVMIFLSTAVSA | 86 |
| prME<br>AHL43502 | AAEITRRGSAYYMYLDRSDAGKAISFATTLGVNKCHVQIMDLGHMCDATM<br>SYECPMLDEGVEPDDVDCWCNTTSTWVVYGTCHHKKGEARRSRRAVTLPS<br>HSTRKLQTRSQTWLESREYTKHLIKVENWIFRNPGFALAAVAIAWLLGSS<br>TSQKVIYLVMILLIAPAYSIRCIGVSNRDFVEGMSGGTWVDVVLEHGGCV | 87 |

TABLE 32-continued

ZIKV Amino Acid Sequences

| Description | Sequence | SEQ ID NO: |
|---|---|---|
| | TVMAQDKPTVDIELVTTTVSNMAEVRSYCYEASISDMASDSRCPTQGEAY LDKQSDTQYVCKRTLVDRGWGNGCGLFGKGSLVTCAKFTCSKKMTGKSIQ PENLEYRIMLSVHGSQHSGMXXXXXGHETDENRAKVEVTPNSPRAEATLG GEGSLGLDCEPRTGLDFSDLYYLTMNNKHRLVRKEWFHDIPLPWHAGADT GTPHWNNKEALVEFKDAHAKRQTVVVLGSQEGAVHTALAGALEAEMDGAK GRLFSGHLKCRLKMDKLRLKGVSYSLCTAAFTFTKVPAETLHGTVTVEVQ YAGTDGPCKVPAQMAVDMQTLTPVGRLITANPVITESTENSKMMLELDPP FGDSYIVIGVGDKKITHHWLKKGSSIGKAFEATVRGAKRMAVLGDTAWDF GSVGGVFNSLGKGVHQIFGAAFKSLFGGMSWFSQILIGTLLVWLGLNTKN GSISLTCLALGGVMIFLSTAVSA | |
| prME AHL43501 | AEITRRGSAYYMYLDRSDAGKAISFATTLGVNKCHVQIMDLGHMCDATMS YECPMLDEGVEPDDVDCWCNTTSTWVVYGTCQHKKGEARRSRRAVTLPSH STRKLQTRSQTWLESREYTKHLIKVENWIFRNPGFALVAVAIAWLLGSST SQKVIYLVMILLIAPAYSIRCIGVSNRDFVEGMSGGTWVDVVLEHGGCVT VMAQDKPTVDIELVTTTVSNMAEVRSYCYEASISDMASDSRCPTQGEAYL DKQSDTQYVCKRTLVDRGWGNGCGLFGKGSLVTCAKFTCSKKMTGKSIQP ENLEYRIMLSVHGSQHSGMIVNDIGHETDENRAKVEVTPNSPRAEATLGG FGSLGLDCEPRTGLDFSDLYYLTMNNKHWLVHKEWFHDIPLPWHAGADTG TPHWNNKEALVEFKDAHAKRQTVVVLGSQEGAVHTALAGALEAEMDGAKG RLFSGHLKCRLKMDKLRLKGVSYSLCTAVCTAAKVPAETLHGTVTVEVQY AGTDGPCKVPAQMAVDMQTLTPVGRLITANPVITESTENSKMMLELDPPF GDSYIVIGVGDKKITHHWHRSGSTIGKAFEATVRGAKRMAVLGDTAWDFG SVGGVFNSLGKGIHQIFGAAFKSLFGGMSWFSQILIGTLLVWLGLNTKNG SISLTCLALGGVMIFLSTAVSA | 88 |
| prME AHL43500 | AEITRRGSAYYMYLDRSDAGKAISFATTLGVNKCHVQIMDLGHMCDATMS YECPMLDEGVEPDDVDCWCNTTSTWVVYGTCHHKKGEARRSRRAVTLPSH STRKLQTRSQTWLESREYTKHLIKVENWIFRNPGFALAAVAIAWLLGSST SQKVIYLIMILLIAPAYSIRCIGVSNRDFVEGMSGGTWVDVVLEHGGCVT VMAQDKPTVDIELVTTTVSNMAEVRSYCYEASISDMASDSRCPTQGEAYL DKQSDTQYVCKRTLVDRGWGNGCGLFGKGSLVTCAKFTCSKKMTGKSIQP ENLEYRIMLSVHGSQHSGMIVNDXXXXXXXNRAEVEVTPNSPRAEATLGG FGSLGLDCEPRTGLDFSDLYYLTMNNKHWLVHKEWFHDIPLPWHAGADTG TPHWNNKEALVEFKDAHAKRQTVVVLGSQEGAVHTALAGALEAEMDGAKG RLFSGHLKCRLKMDKLRLKGVSYSLCTAAFTFTKVPAETLHGTVTVEVQY AGTDGPCKVPAQMAVDMQTLTPVGRLITANPVITESTENSKMMLELDPPF GDSYIVIGVGDKKITHHWHRSGSTIGKAFEATVRGAKRMAVLGDTAWDFG SVGGVFNSLGKGIHQIFGAAFKSLFGGMSWFSQILIGTLLVWLGLNTKNG SISLTCLALGGVMIFLSTAVSA | 89 |
| prME AHF49785 | AEITRRGSAYYMYLDRSDAGKAISFATNLGVNKCHVQIMDLGHMCDATMS YECPMLDEGVEPDDVDCWCNTTSTWVVYGTCHHKKGEARRSRRAVTLPSH STRKLQTRSQTWLESREYTKHLIKVENWIFRNPGFALAAVAIAWLLGSST SQKVIYLVMILLIAPAYSIRCIGVSNRDFVEGMSGGTWVDVVLEHGGCVT VMAQDKPTVDIELVTTTVSNMAEVRSYCYEASISDMASDSRCPTQGEAYL DKQSDTQYVCKRTLVDRGWGNGCGLFGKGSLVTCAKFTCSKKMTGKSIQP ENLEYRIMLSVHGSQHSGMIVNDIGHETDENRAKVEVTPNSPRAEATLGG FGSLGLDCEPRTGLDFSDLYYLTMNNKHWLVHKEWFHDIPLPWHAGADTG TPHWNNKEALVEFKDAHAKRQTVVVLGSQEGAVHTALAGALEAEMDGAKG RLFSGHLKCRLKMDKLRLKGVSYSLCTAAFTFTKVPAETLHGTVTVEVQY AGTDGPCKVPAQMAVDMQTLTPVGRLITANPVITESTENSKMMLELDPPF GDSYIVIGVGDKKITHHWHRSGSTIGKAFEATVRGAKRMAVLGDTAWDFG SVGGVFNSLGKGVHQIFGAAFKSLFGGMSWFSQILIGTLLVWLGLNTKNG SISLTCLALGGVMIFLSTAVSA | 90 |
| prME AHF49784_1976 | AEITRRGSAYYMYLDRSDAGKAISFATNLGVNKCHVQIMDLGHMCDATMS YECPMLDEGVEPDDVDCWCNTTSTWVVYGTCHHKKGEARRSRRAVTLPSH STRKLQTRSQTWLESREYTKHLIKVENWIFRNPGFALAAVAIAWLLGSST SQKVIYLVMILLIAPAYSIRCIGVSNRDFVEGMSGGTWVDVVLEHGGCVT VMAQDKPTVDIELVTTTVSNMAEVRSYCYEASISDMASDSRCPTQGEAYL DKQSDTQYVCKRTLVDRGWGNGCGLFGKGSLVTCAKFTCSKKMTGKSIQP ENLEYRIMLSVHGSQHSGMIVNDENRAKVEVTPNSPRAEATLGGEGSLGL DCEPRTGLDFSDLYYLTMNNKHWLVHKEWFHDIPLPWHAGADTGTPHWNN KEALVEFKDAHAKRQTVVVLGSQEGAVHTALAGALEAEMDGAKGRLFSGH LKCRLKMDKLRLKGVSYSLCTAAFTFTKVPAETLHGTVTVEVQYAGTDGP CKVPAQMAVDMQTLTPVGRLITANPVITESTENSKMMLELDPPFGDSYIV IGVGDKKITHHWHRSGSTIGKAFEATVRGAKRMAVLGDTAWDFGSVGGVF NSLGKGIHQIFGAAFKSLFGGMSWFSQILIGTLLVWLGLNTKNGSISLTC LALGGVMIFLSTAVSA | 91 |
| prME AHF49783 | AEITRRGSAYYMYLDRSDAGKAISFATNLGVNKCHVQIMDLGHMCDATMS YECPMLDEGVEPDDVDCWCNTTSTWVVYGTCHHKKGEARRSRRAVTLPSH STRKLQTRSQTWLESREYTKHLIKVENWIFRNPGFALAAVAIAWLLGSST | 92 |

TABLE 32-continued

ZIKV Amino Acid Sequences

| Description | Sequence | SEQ ID NO: |
|---|---|---|
| | SQKVIYLVMILLIAPAYSIRCIGVSNRDFVEGMSGGTWVDVVLEHGGCVT VMAQDKPTVDIELVTTTVSNMAEVRSYCYEASISDMASDSRCPTQGEAYL DKQSDTQYVCKRTLVDRGWGNGCGLFGKGSLVTCAKFTCSKKMTGKSIQP ENLEYRIMLSVHGSQHSGMIVNDIGHETDENRAKVEVTPNSPRAEATLGG FGSLGLDCEPRTGLDFSDLYYLTMNNKHWLVHKEWFHDIPLPWHAGADTG TPHWNNKEALVEFKDAHAKRQTVVVLGSQEGAVHTALAGALEAEMDGAKG RLFSGHLKCRLKMDKLRLKGVSYSLCTAAFTFTKVPAETLHGTVTVEVQY AGTDGPCKVPAQMAVDMQTLTPVGRLITANPVITESTENSKMMLELDPPF GDSYIVIGVGDKKITHHWHRSGSTIGKAFEATVRGAKRMAVLGDTAWDFG SVGGVFNSLGKGVHQIFGAAFKSLFGGMSWFSQILIGTLLVWLGLNTKNG SISLTCLALGGVMIFLSTAVSA | |
| prME ACD75819_ Micronesia | VEVTRRGSAYYMYLDRSDAGEAISEPTTLGMNKCYIQIMDLGHMCDATMS YECPMLDEGVEPDDVDCWCNTTSTWVVYGTCHHKKGEARRSRRAVTLPSH STRKLQTRSQTWLESREYTKHLIRVENWIFRNPGFALAAAAIAWLLGSST SQKVIYLVMILLIAPAYSIRCIGVSNRDFVEGMSGGTWVDVVLEHGGCVT VMAQDKPAVDIELVTTTVSNMAEVRSYCYEASISDMASDSRCPTQGEAYL DKQSDTQYVCKRTLVDRGWGNGCGLFGKGSLVTCAKFACSKKMTGKSIQP ENLEYRIMLSVHGSQHSGMIVNDTGHETDENRAKVEITPNSPRAEATLGG FGSLGLDCEPRTGLDFSDLYYLTMNNKHWLVHKEWFHDIPLPWHAGADTG TPHWNNKEALVEFKDAHAKRQTVVVLGSQEGAVHTALAGALEAEMDGAKG RLSSGHLKCRLKMDKLRLKGVSYSLCTAAFTFTKIPAETLHGTVTVEVQY AGTDGPCKVPAQMAVDMQTLTPVGRLITANPVITESTENSKMMLELDPPF GDSYIVIGVGEKKITHHWHRSGSTIGKAFEATVRGAKRMAVLGDTAWDFG SVGGALNSLGKGIHQIFGAAFKSLFGGMSWFSQILIGTLLVWLGLNTKNG SISLTCLALGGVLIFLSTAVSA | 93 |
| prME ABI54475 | AEITRRGSAYYMYLDRSDAGKAISFATTLGVNKCHVQIMDLGHMCDATMS YECPMLDEGVEPDDVDCWCNTTSTWVVYGTCHHKKGEARRSRRAVTLPSH STRKLQTRSQTWLESREYTKHLIKVENWIFRNPGFTLVAVAIAWLLGSST SQKVIYLVMILLIAPAYSIRCIGVSNRDFVEGMSGGTWVDVVLEHGGCVT VMAQDKPTVDIELVTTTVSNMAEVRSYCYEASISDMASDSRCPTQGEAYL DKQSDTQYVCKRTLVDRGWGNGCGLFGKGSLVTCAKFTCSKKMTGKSIQP ENLEYRIMLSVHGSQHSGMIVNDENRAKVEVTPNSPRAEATLGGFGSLGL DCEPRTGLDFSDLYYLTMNNKHWLVHKEWFHDIPLPWHAGADTGTPHWNN KEALVEFKDAHAKRQTVVVLGSQEGAVHTALAGALEAEMDGAKGRLFSGH LKCRLKMDKLRLKGVSYSLCTAAFTFTKVPAETLHGTVTVEVQYAGTDGP CKVPAQMAVDMQTLTPVGRLITANPVITESTENSKMMLELDPPFGDSYIV IGVGDKKITHHWHRSGSTIGKAFEATVRGAKRMAVLGDTAWDFGSVGGVF NSLGKGIHQIFGAAFKSLFGGMSWFSQILIGTLLVWLGLNTKNGSISLTC LALGGVMIFLSTAVSA | 94 |
| prME YP_002790881 | AEITRRGSAYYMYLDRSDAGKAISFATTLGVNKCHVQIMDLGHMCDATMS YECPMLDEGVEPDDVDCWCNTTSTWVVYGTCHHKKGEARRSRRAVTLPSH STRKLQTRSQTWLESREYTKHLIKVENWIFRNPGFALVAVAIAWLLGSST SQKVIYLVMILLIAPAYSIRCIGVSNRDFVEGMSGGTWVDVVLEHGGCVT VMAQDKPTVDIELVTTTVSNMAEVRSYCYEASISDMASDSRCPTQGEAYL DKQSDTQYVCKRTLVDRGWGNGCGLFGKGSLVTCAKFTCSKKMTGKSIQP ENLEYRIMLSVHGSQHSGMIGYETDEDRAKVEVTPNSPRAEATLGGFGSL GLDCEPRTGLDFSDLYYLTMNNKHWLVHKEWFHDIPLPWHAGADTGTPHW NNKEALVEFKDAHAKRQTVVVLGSQEGAVHTALAGALEAEMDGAKGRLFS GHLKCRLKMDKLRLKGVSYSLCTAAFTFTKVPAETLHGTVTVEVQYAGTD GPCKIPVQMAVDMQTLTPVGRLITANPVITESTENSKMMLELDPPFGDSY IVIGVGDKKITHHWHRSGSTIGKAFEATVRGAKRMAVLGDTAWDFGSVGG VFNSLGKGIHQIFGAAFKSLFGGMSWFSQILIGTLLVWLGLNTKNGSISL TCLALGGVMIFLSTAVSA | 95 |
| prME BAP4744 | AEITRRGSAYYMYLDRSDAGKAISFATTLGVNKCHVQIMDLGHMCDATMS YECPMLDEGVEPDDVDCWCNTTSTWVVYGTCHHKKGEARRSRRAVTLPSH STRKLQTRSQTWLESREYTKHLIKVENWIFRNPGFALVAVAIAWLLGSST SQKVIYLVMILLIAPAYSIRCIGVSNRDFVEGMSGGTWVDVVLEHGGCVT VMAQDKPTVDIELVTTTVSNMAEVRSYCYEASISDMASDSRCPTQGEAYL DKQSDTQYVCKRTLVDRGWGNGCGLFGKGSLVTCAKFTCSKKMTGKSIQP ENLEYRIMLSVHGSQHSGMTVNDIGYETDENRAKVEVTPNSPRAEATLGG FGSLGLDCEPRTGLDFSDLYYLTMNNKHWLVHKEWFHDIPLPWHAGADTG TPHWNNKEALVEFKDAHAKRQTVVVLGSQEGAVHTALAGALEAEMDGAKG KLFSGHLKCRLKMDKLRLKGVSYSLCTAAFTFTKVPAETLHGTVTVEVQY AGTDGPCKIPVQMAVDMQTLTPVGRLITANPVITESTENSKMMLELDPPF GDSYIVIGVGDKKITHHWHRSGSTIGKAFEATVRGAKRMAVLGDTAWDFG SVGGVFNSLGKGIHQIFGAAFKSLFGGMSWFSQILIGTLLVWLGLNTKNG SISLTCLALGGVMIFLSTAVSA | 96 |

TABLE 32-continued

ZIKV Amino Acid Sequences

| Description | Sequence | SEQ ID NO: |
|---|---|---|
| prME | AEVTRRGSAYYMYLDRNDAGEAISEPTTLGMNKCYIQIMDLGHMCDATMS | 97 |
| KU365780_ | YECPMLDEGVEPDDVDCWCNTTSTWVVYGTCHHKKGEARRSRRAVTLPSH | |
| 2015_Brazil_ | STRKLQTRSQTWLESREYTKHLIRVENWIFRNPGFALAAAAIAWLLGSST | |
| isolate_ | SQKVIYLVMILLIAPAYSIRCIGVSNRDFVEGMSGGTWVDVVLEHGGCVT | |
| BeH815744 | VMAQDKPTVDIELVTTTVSNMAEVRSYCYEASISDMASDSRCPTQGEAYL | |
| | DKQSDTQYVCKRTLVDRGWGNGCGLFGKGSLVTCAKFACSKKMTGKSIQP | |
| | ENLEYRIMLSVHGSQHSGMIVNDTGHETDENRAKVEITPNSPRAEATLGG | |
| | FGSLGLDCEPRTGLDFSDLYYLTMNNKHWLVHKEWFHDIPLPWHAGADTG | |
| | TPHWNNKEALVEFKDAHAKRQTVVVLGSQEGAVHTALAGALEAEMDGAKG | |
| | RLSSGHLKCRLKMDKLRLKGVSYSLCTAAFTFTKIPAETLHGTVTVEVQY | |
| | AGTDGPCKVPAQMAVDMQTLTPVGRLITANPVITESTENSKMMLELDPPF | |
| | GDSYIVIGVGEKKITHHWHRSGSTIGKAFEATVRGAKRMAVLGDTAWDFG | |
| | SVGGALNSLGKGIHQIFGAAFKSLFGGMSWFSQILIGTLLMWLGLNTKNG | |
| | SISLMCLALGGVLIFLSTAVSA | |
| prME | AEVTRRGSAYYMYLDRNDAGEAISEPTTLGMNKCYIQIMDLGHMCDATMS | 98 |
| KU365779_ | YECPMLDEGVEPDDVDCWCNTTSTWVVYGTCHHKKGEARRSRRAVTLPSH | |
| 2015_Brazil_ | STRKLQTRSQTWLESREYTKHLIRVENWIFRNPGFALAAAAIAWLLGSST | |
| isolate_ | SQKVIYLVMILLIAPAYSIRCIGVSNRDFVEGMSGGTWVDVVLEHGGCVT | |
| BeH819966 | VMAQDKPTVDIELVTTTVSNMAEVRSYCYEASISDMASDSRCPTQGEAYL | |
| | DKQSDTQYVCKRTLVDRGWGNGCGLFGKGSLVTCAKFACSKKMTGKSIQP | |
| | ENLEYRIMLSVHGSQHSGMIVNDTGHETDENRAKVEITPNSPRAEATLGG | |
| | FGSLGLDCEPRTGLDFSDLYYLTMNNKHWLVHKEWFHDIPLPWHAGADTG | |
| | TPHWNNKEALVEFKDAHAKRQTVVVLGSQEGAVHTALAGALEAEMDGAKG | |
| | RLSSGHLKCRLKMDKLRLKGVSYSLCTAAFTFTKIPAETLHGTVTVEVQY | |
| | AGTDGPCKVPAQMAVDMQTLTPVGRLITANPVITESTENSKMMLELDPPF | |
| | GDSYIVIGVGEKKITHHWHRSGSTIGKAFEATVRGAKRMAVLGDTAWDFG | |
| | SVGGALNSLGKGIHQIFGAAFKSLFGGMSWFSQILIGTLLMWLGLNTKNG | |
| | SISLMCLALGGVLIFLSTAVSA | |
| prME | AEVTRRGSAYYMYLDRNDAGEAISEPTTLGMNKCYIQIMDLGHMCDATMS | 99 |
| KU365778_ | YECPMLDEGVEPDDVDCWCNTTSTWVVYGTCHHKKGEARRSRRAVTLPSH | |
| 2015_Brazil_ | STRKLQTRSQTWLESREYTKHLIRVENWIFRNPGFALAAAAIAWLLGSST | |
| isolate_ | SQKVIYLVMILLIAPAYSIRCIGVSNRDFVEGMSGGTWVDVVLEHGGCVT | |
| BeH819015 | VMAQDKPTVDIELVTTTVSNMAEVRSYCYEASISDMASDSRCPTQGEAYL | |
| | DKQSDTQYVCKRTLVDRGWGNGCGLFGKGSLVTCAKFACSKKMTGKSIQP | |
| | ENLEYRIMLSVHGSQHSGMIVNDTGHETDENRAKVEITPNSPRAEATLGG | |
| | FGSLGLDCEPRTGLDFSDLYYLTMNNKHWLVHKEWFHDIPLPWHAGADTG | |
| | TPHWNNKEALVEFKDAHAKRQTVVVLGSQEGAVHTALAGALEAEMDGAKG | |
| | RLSSGHLKCRLKMDKLRLKGVSYSLCTAAFTFTKIPAETLHGTVTVEVQY | |
| | AGTDGPCKVPAQMAVDMQTLTPVGRLITANPVITESTENSKMMLELDPPF | |
| | GDSYIVIGVGEKKITHHWHRSGSTIGKAFEATVRGAKRMAVLGDTAWDFG | |
| | SVGGALNSLGKGIHQIFGAAFKSLFGGMSWFSQILIGTLLMWLGLNTKNG | |
| | SISLMCLALGGVLIFLSTAVSA | |
| prME | AEVTRRGSAYYMYLDRNDAGEAISEPTTLGMNKCYIQIMDLGHMCDATMS | 100 |
| KU365777_ | YECPMLDEGVEPDDVDCWCNTTSTWVVYGTCHHKKGEARRSRRAVTLPSH | |
| 2015_Brazil_ | STRKLQTRSQTWLESREYTKHLIRVENWIFRNPGFALAAAAIAWLLGSST | |
| isolate_ | SQKVIYLVMILLIAPAYSIRCIGVSNRDFVEGMSGGTWVDVVLEHGGCVT | |
| BeH818995 | VMAQDKPTVDIELVTTTVSNMAEVRSYCYEASISDMASDSRCPTQGEAYL | |
| | DKQSDTQYVCKRTLVDRGWGNGCGLFGKGSLVTCAKFACSKKMTGKSIQP | |
| | ENLEYRIMLSVHGSQHSGMIVNDTGHETDENRAKVEITPNSPRAEATLGG | |
| | FGSLGLDCEPRTGLDFSDLYYLTMNNKHWLVHKEWFHDIPLPWHAGADTG | |
| | TPHWNNKEALVEFKDAHAKRQTVVVLGSQEGAVHTALAGALEAEMDGAKG | |
| | RLSSGHLKCRLKMDKLRLKGVSYSLCTAAFTFTKIPAETLHGTVTVEVQY | |
| | AGTDGPCKVPAQMAVDMQTLTPVGRLITANPVITESTENSKMMLELDPPF | |
| | GDSYIVIGVGEKKITHHWHRSGSTIGKAFEATVRGAKRMAVLGDTAWDFG | |
| | SVGGALNSLGKGIHQIFGAAFKSLFGGMSWFSQILIGTLLMWLGLNTKNG | |
| | SISLMCLALGGVLIFLSTAVSA | |
| prME | AEVTRRGSAYYMYLDRNDAGEAISEPTTLGMNKCYIQIMDLGHMCDATMS | 101 |
| KU321639_ | YECPMLDEGVEPDDVDCWCNTTSTWVVYGTCHHKKGEARRSRRAVTLPSH | |
| 2015_Brazil_ | STRKLQTRSQTWLESREYTKHLIRVENWIFRNPGFALAAAAIAWLLGSST | |
| isolate_ | SQKVIYLVMILLIAPAYSIRCIGVSNRDFVEGMSGGTWVDIVLEHGGCVT | |
| ZikaSPH2015 | VMAQDKPTVDIELVTTTVSNMAEVRSYCYEASISDMASDSRCPTQGEAYL | |
| | DKQSDTQYVCKRTLVDRGWGNGCGLFGKGSLVTCAKFACSKKMTGKSIQP | |
| | ENLEYRIMLSVHGSQHSGMIVNDTGHETDENRAKVEITPNSPRAEATLGG | |
| | FGSLGLDCEPRTGLDFSDLYYLTMNNKHWLVHKEWFHDIPLPWHAGADTG | |
| | TPHWNNKEALVEFKDAHAKRQTVVVLGSQEGAVHTALAGALEAEMDGAKG | |

TABLE 32-continued

ZIKV Amino Acid Sequences

| Description | Sequence | SEQ ID NO: |
| --- | --- | --- |
| | RLSSGHLKCRLKMDKLRLKGVSYSLCTAAFTFTKIPAETLHGTVTVEVQY AGTDGPCKVPAQMAVDMQTLTPVGRLITANPVITESTENSKMMLELDPPF GDSYIVIGVGEKKITHHWHRSGSTIGKAFEATVRGAKRMAVLGDTAWDFG SVGGALNSLGKGIHQIFGAAFKSLFGGMSWFSQILIGTLLMWLGLNTKNG SISLMCLALGGVLIFLSTAVSA | |
| prME KU312312_ 2015_Suriname_ isolate_ Z1106033 | AEVTRRGSAYYMYLDRNDAGEAISEPTTLGMNKCYIQIMDLGHTCDATMS YECPMLDEGVEPDDVDCWCNTTSTWVVYGTCHHKKGEARRSRRAVTLPSH STRKLQTRSQTWLESREYTKHLIRVENWIFRNPGFALAAAAIAWLLGSST SQKVIYLVMILLIAPAYSIRCIGVSNRDFVEGMSGGTWVDVVLEHGGCVT VMAQDKPTVDIELVTTTVSNMAEVRSYCYEASISDMASDSRCPTQGEAYL DKQSDTQYVCKRTLVDRGWGNGCGLFGKGSLVTCAKFACSKKMTGKSIQP ENLEYRIMLSVHGSQHSGMIVNDTGHETDENRAKVEITPNSPRAEATLGG FGSLGLDCEPRTGLDFSDLYYLTMNNKHWLVHKEWFHDIPLPWHAGADTG TPHWNNKEALVEFKDAHAKRQTVVVLGSQEGAVHTALAGALEAEMDGAKG RLSSGHLKCRLKMDKLRLKGVSYSLCTAAFTFTKIPAETLHGTVTVEVQY AGTDGPCKVPAQMAVDMQTLTPVGRLITANPVITESTENSKMMLELDPPF GDSYIVIGVGEKKITHHWHRSGSTIGKAFEATVRGAKRMAVLGDTAWDFG SVGGALNSLGKGIHQIFGAAFKSLFGGMSWFSQILIGTLLMWLGLNAKNG SISLMCLALGGVLIFLSTAVSA | 102 |
| Premembrane/ membrane protein KU321639_ 2015_Brazil_ isolate_ ZikaSPH2015 | AEVTRRGSAYYMYLDRNDAGEAISEPTTLGMNKCYIQIMDLGHMCDATMS YECPMLDEGVEPDDVDCWCNTTSTWVVYGTCHHKKGEARRSRRAVTLPSH STRKLQTRSQTWLESREYTKHLIRVENWIFRNPGFALAAAAIAWLLGSST SQKVIYLVMILLIAPAYS | 103 |
| Envelop protein KU321639_ 2015_Brazil_ isolate_ ZikaSPH2015 | IRCIGVSNRDFVEGMSGGTWVDIVLEHGGCVTVMAQDKPTVDIELVTTTV SNMAEVRSYCYEASISDMASDSRCPTQGEAYLDKQSDTQYVCKRTLVDRG WGNGCGLFGKGSLVTCAKFACSKKMTGKSIQPENLEYRIMLSVHGSQHSG MIVNDTGHETDENRAKVEITPNSPRAEATLGGFGSLGLDCEPRTGLDFSD LYYLTMNNKHWLVHKEWFHDIPLPWHAGADTGTPHWNNKEALVEFKDAHA KRQTVVVLGSQEGAVHTALAGALEAEMDGAKGRLSSGHLKCRLKMDKLRL KGVSYSLCTAAFTFTKIPAETLHGTVTVEVQYAGTDGPCKVPAQMAVDMQ TLTPVGRLITANPVITESTENSKMMLELDPPFGDSYIVIGVGEKKITHHW HRSGSTIGKAFEATVRGAKRMAVLGDTAWDFGSVGGALNSLGKGIHQIFG AAFKSLFGGMSWFSQILIGTLLMWLGLNTKNGSISLMCLALGGVLIFLST AVSA | 104 |
| Capsid protein KU321639_ 2015_Brazil_ isolate_ ZikaSPH2015 | MKNPKKKSGGFRIVNMLKRGVARVSPEGGLKRLPAGLLLGHGPIRMVLAI LAFLRFTAIKPSLGLINRWGSVGKKEAMEIIKKFKKDLAAMLRIINARKE KKRRGADTSVGIVGLLLTTAMAAEV | 105 |
| Non-structural protein 1 KU321639_ 2015_Brazil_ isolate_ ZikaSPH2015 | VGCSVDFSKKETRCGTGVFVYNDVEAWRDRYKYHPDSPRRLAAAVKQAWE DGICGISSVSRMENIMWRSVEGELNAILEENGVQLTVVVGSVKNPMWRGP QRLPVPVNELPHGWKAWGKSHEVRAAKTNNSFVVDGDTLKECPLKHRAWN SFLVEDHGFGVFHTSVWLKVREDYSLECDPAVIGTAVKGKEAVHSDLGYW IESEKNDTWRLKRAHLIEMKTCEWPKSHTLWTDGIEESDLIIPKSLAGPL SHHNTREGYRTQMKGPWHSEELEIRFEECPGTKVHVEETCGTRGPSLRST TASGRVIEEWCCRECTMPPLSFRAKDGCWYGMEIRPRKEPESNLVRSMVT AGSTDHMDHFSL | 106 |
| Non-structural protein 2A KU321639_ 2015_Brazil_ isolate_ ZikaSPH2015 | GVLVILLMVQEGLKKRMTTKIIISTSMAVLVAMILGGFSMSDLAKLAILM GATFAEMNTGGDVAHLALIAAFKVRPALLVSFIFRANWTPRESMLLALAS CLLQTAISALEGDLMVLINGFALAWLAIRAMVVPRTDNITLAILAALTPL ARGTLLVAWRAGLATCGGFMLLSLKGKGSVKKNLPFVMALGLTAVRLVDP INVVGLLLLTRSGKRSWP | 107 |
| Non-structural protein 2B KU321639_ 2015_Brazil_ isolate_ ZikaSPH2015 | PSEVLTAVGLICALAGGFAKADIEMAGPMAAVGLLIVSYVVSGKSVDMYI ERAGDITWEKDAEVTGNSPRLDVALDESGDFSLVEDDGPPMREIILKVVL MTICGMNPIAIPFAAGAWYVYVKTGKRSGALWDVPAPKEVKKGE | 108 |

TABLE 32-continued

ZIKV Amino Acid Sequences

| Description | Sequence | SEQ ID NO: |
|---|---|---|
| Non-structural protein 3 KU321639_ 2015_Brazil_ isolate_ ZikaSPH2015 | TTDGVYRVMTRRLLGSTQVGVGVMQEGVFHTMWHVTKGSALRSGEGRLDP YWGDVKQDLVSYCGPWKLDAAWDGHSEVQLLAVPPGERARNIQTLPGIFK TKDGDIGAVALDYPAGTSGSPILDKCGRVIGLYGNGVVIKNGSYVSAITQ GRREEETPVECFEPSMLKKKQLTVLDLHPGAGKTRRVLPEIVREAIKTRL RTVILAPTRVVAAEMEEALRGLPVRYMTTAVNVTHSGTEIVDLMCHATFT SRLLQPIRVPNYNLYIMDEAHFTDPSSIAARGYISTRVEMGEAAAIFMTA TPPGTRDAFPDSNSPIMDTEVEVPERAWSSGFDWVTDYSGKTVWFVPSVR NGNEIAACLTKAGKRVIQLSRKTFETEFQKTKHQEWDFVVTTDISEMGAN FKADRVIDSRRCLKPVILDGERVILAGPMPVTHASAAQRRGRIGRNPNKP GDEYLYGGGCAETDEDHAHWLEARMLLDNIYLQDGLIASLYRPEADKVAA IEGEFKLRTEQRKTFVELMKRGDLPVWLAYQVASAGITYTDRRWCFDGTT NNTIMEDSVPAEVWTRHGEKRVLKPRWMDARVCSDHAALKSFKEFAAGKR GAA | 109 |
| Non-structural protein 4A KU321639_ 2015_Brazil_ isolate_ ZikaSPH2015 | FGVMEALGTLPGHMTERFQEAIDNLAVLMRAETGSRPYKAAAAQLPETLE TIMLLGLLGTVSLGIFFVLMRNKGIGKMGFGMVTLGASAWLMWLSEIEPA RIACVLIVVFLLLVVLIPEPEKQRSPQDNQMAIIIMVAVGLLGLITA | 110 |
| Non-structural protein 4B KU321639_ 2015_Brazil_ isolate_ ZikaSPH2015 | NELGWLERTKSDLSHLMGRREEGATMGFSMDIDLRPASAWAIYAALTTFI TPAVQHAVTTSYNNYSLMAMATQAGVLFGMGKGMPFYAWDFGVPLLMIGC YSQLTPLTLIVAIILLVAHYMYLIPGLQAAAARAAQKRTAAGIMKNPVVD GIVVTDIDTMTIDPQVEKKMGQVLLMAVAVSSAILSRTAWGWGEAGALIT AATSTLWEGSPNKYWNSSTATSLCNIFRGSYLAGASLIYTVTRNAGLVKR RGGGTGETLGEKWKARLNQMSALEFYSYKKSGITEVCREEARRALKDGVA TGGHAVSRGSAKLRWLVERGYLQPYGKVIDLGCGRGGWSYYAATIRKVQE VKGYTKGGPGHEEPVLVQSYGWNIVRLKSGVDVFHMAAEPCDTLLCDIGE SSSSPEVEEARTLRVLSMVGDWLEKRPGAFCIKVLCPYTSTMMETLERLQ RRYGGGLVRVPLSRNSTHEMYWVSGAKSNTIKSVSTTSQLLLGRMDGPRR PV | 111 |
| Non-structural protein 5 KU321639_ 2015_Brazil_ isolate_ ZikaSPH2015 | KYEEDVNLGSGTRAVVSCAEAPNMKIIGNRIERIRSEHAETWFFDENHPY RTWAYHGSYEAPTQGSASSLINGVVRLLSKPWDVVTGVTGIAMTDTTPYG QQRVFKEKVDTRVPDPQEGTRQVMSMVSSWLWKELGKHKRPRVCTKEEFI NKVRSNAALGAIFEEEKEWKTAVEAVNDPRFWALVDKEREHHLRGECQSC VYNMMGKREKKQGEFGKAKGSRAIWYMWLGARFLEFEALGFLNEDHWMGR ENSGGGVEGLGLQRLGYVLEEMSRIPGGRMYADDTAGWDTRISRFDLENE ALITNQMEKGHRALALAIIKYTYQNKVVKVLRPAEKGKTVMDIISRQDQR GSGQVVTYALNTFTNLVVQLIRNMEAEEVLEMQDLWLLRRSEKVTNWLQS NGWDRLKRMAVSGDDCVVKPIDDRFAHALRFLNDMGKVRKDTQEWKPSTG WDNWEEVPFCSHHFNKLHLKDGRSIVVPCRHQDELIGRARVSPGAGWSIR ETACLAKSYAQMWQLLYFHRRDLRLMANAICSSVPVDWVPTGRTTWSIHG KGEWMTTEDMLVVWNRVWIEENDHMEDKTPVTKWTDIPYLGKREDLWCGS LIGHRPRTTWAENIKNTVNMVRRIIGDEEKYMDYLSTQVRYLGEEGSTPG VL | 112 |
| Signal peptide_prM-E | METPAQLLFLLLLWLPDTTGAEVTRRGSAYYMYLDRNDAGEAISFPTTLG MNKCYIQIMDLGHMCDATMSYECPMLDEGVEPDDVDCWCNTTSTWVVYGT CHHKKGEARRSRRAVTLPSHSTRKLQTRSQTWLESREYTKHLIRVENWIF RNPGFALAAAAIAWLLGSSTSQKVIYLVMILLIAPAYSIRCIGVSNRDFV EGMSGGTWVDIVLEHGGCVTVMAQDKPTVDIELVTTTVSNMAEVRSYCYE ASISDMASDSRCPTQGEAYLDKQSDTQYVCKRTLVDRGWGNGCGLFGKGS LVTCAKFACSKKMTGKSIQPENLEYRIMLSVHGSQHSGMIVNDTGHETDE NRAKVEITPNSPRAEATLGGFGSLGLDCEPRTGLDFSDLYYLTMNNKHWL VHKEWFHDIPLPWHAGADTGTPHWNNKEALVEFKDAHAKRQTVVVLGSQE GAVHTALAGALEAEMDGAKGRLSSGHLKCRLKMDKLRLKGVSYSLCTAAF TFTKIPAETLHGTVTVEVQYAGTDGPCKVPAQMAVDMQTLTPVGRLITAN PVITESTENSKMMLELDPPFGDSYIVIGVGEKKITHHWHRSGSTIGKAFE ATVRGAKRMAVLGDTAWDFGSVGGALNSLGKGIHQIFGAAFKSLFGGMSW FSQILIGTLLMWLGLNTKNGSISLMCLALGGVLIFLSTAVSA | 113 |
| Signal peptide_E | METPAQLLFLLLLWLPDTTGIRCIGVSNRDFVEGMSGGTWVDIVLEHGGC VTVMAQDKPTVDIELVTTTVSNMAEVRSYCYEASISDMASDSRCPTQGEA YLDKQSDTQYVCKRTLVDRGWGNGCGLFGKGSLVTCAKFACSKKMTGKSI QPENLEYRIMLSVHGSQHSGMIVNDTGHETDENRAKVEITPNSPRAEATL GGEGSLGLDCEPRTGLDFSDLYYLTMNNKHWLVHKEWFHDIPLPWHAGAD TGTPHWNNKEALVEFKDAHAKRQTVVVLGSQEGAVHTALAGALEAEMDGA KGRLSSGHLKCRLKMDKLRLKGVSYSLCTAAFTFTKIPAETLHGTVTVEV QYAGTDGPCKVPAQMAVDMQTLTPVGRLITANPVITESTENSKMMLELDP | 114 |

TABLE 32-continued

ZIKV Amino Acid Sequences

| Description | Sequence | SEQ ID NO: |
|---|---|---|
| | PFGDSYIVIGVGEKKITHHWHRSGSTIGKAFEATVRGAKRMAVLGDTAWD FGSVGGALNSLGKGIHQIFGAAFKSLFGGMSWFSQILIGTLLMWLGLNTK NGSISLMCLALGGVLIFLSTAVSA | |
| IgE HC signal peptide_prM-E #1 (Brazil_isolate_ ZikaSPH2015) | MDWTWILFLVAAATRVHSVEVTRRGSAYYMYLDRSDAGEAISEPTTLGMN KCYIQIMDLGHMCDATMSYECPMLDEGVEPDDVDCWCNTTSTWVVYGTCH HKKGEARRSRRAVTLPSHSTRKLQTRSQTWLESREYTKHLIRVENWIFRN PGFALAAAAIAWLLGSSTSQKVIYLVMILLIAPAYSIRCIGVSNRDFVEG MSGGTWVDVVLEHGGCVTVMAQDKPAVDIELVTTTVSNMAEVRSYCYEAS ISDMASDSRCPTQGEAYLDKQSDTQYVCKRTLVDRGWGNGCGLFGKGSLV TCAKFACSKKMTGKSIQPENLEYRIMLSVHGSQHSGMIVNDTGHETDENR AKVEITPNSPRAEATLGGEGSLGLDCEPRTGLDFSDLYYLTMNNKHWLVH KEWFHDIPLPWHAGADTGTPHWNNKEALVEFKDAHAKRQTVVVLGSQEGA VHTALAGALEAEMDGAKGRLSSGHLKCRLKMDKLRLKGVSYSLCTAAFTF TKIPAETLHGTVTVEVQYAGTDGPCKVPAQMAVDMQTLTPVGRLITANPV ITESTENSKMMLELDPPFGDSYIVIGVGEKKITHHWHRSGSTIGKAFEAT VRGAKRMAVLGDTAWDFGSVGGALNSLGKGIHQIFGAAFKSLFGGMSWFS QILIGTLLVWLGLNTKNGSISLTCLALGGVLIFLSTAVSA | 115 |
| IgE HC signal peptide_prM-E #1 (ACD75819_ Micronesia) | MDWTWILFLVAAATRVHSVEVTRRGSAYYMYLDRSDAGEAISEPTTLGMN KCYIQIMDLGHMCDATMSYECPMLDEGVEPDDVDCWCNTTSTWVVYGTCH HKKGEARRSRRAVTLPSHSTRKLQTRSQTWLESREYTKHLIRVENWIFRN PGFALAAAAIAWLLGSSTSQKVIYLVMILLIAPAYSIRCIGVSNRDFVEG MSGGTWVDVVLEHGGCVTVMAQDKPAVDIELVTTTVSNMAEVRSYCYEAS ISDMASDSRCPTQGEAYLDKQSDTQYVCKRTLVDRGWGNGCGLFGKGSLV TCAKFACSKKMTGKSIQPENLEYRIMLSVHGSQHSGMIVNDTGHETDENR AKVEITPNSPRAEATLGGEGSLGLDCEPRTGLDFSDLYYLTMNNKHWLVH KEWFHDIPLPWHAGADTGTPHWNNKEALVEFKDAHAKRQTVVVLGSQEGA VHTALAGALEAEMDGAKGRLSSGHLKCRLKMDKLRLKGVSYSLCTAAFTF TKIPAETLHGTVTVEVQYAGTDGPCKVPAQMAVDMQTLTPVGRLITANPV ITESTENSKMMLELDPPFGDSYIVIGVGEKKITHHWHRSGSTIGKAFEAT VRGAKRMAVLGDTAWDFGSVGGALNSLGKGIHQIFGAAFKSLFGGMSWFS QILIGTLLVWLGLNTKNGSISLTCLALGGVLIFLSTAVSA | 116 |
| IgE HC signal peptide_prM-E #2 (Brazil_isolate_ ZikaSPH2015) | MDWTWILFLVAAATRVHSTRRGSAYYMYLDRSDAGEAISEPTTLGMNKCY IQIMDLGHMCDATMSYECPMLDEGVEPDDVDCWCNTTSTWVVYGTCHHKK GEARRSRRAVTLPSHSTRKLQTRSQTWLESREYTKHLIRVENWIFRNPGF ALAAAAIAWLLGSSTSQKVIYLVMILLIAPAYSIRCIGVSNRDFVEGMSG GTWVDVVLEHGGCVTVMAQDKPAVDIELVTTTVSNMAEVRSYCYEASISD MASDSRCPTQGEAYLDKQSDTQYVCKRTLVDRGWGNGCGLFGKGSLVTCA KFACSKKMTGKSIQPENLEYRIMLSVHGSQHSGMIVNDTGHETDENRAKV EITPNSPRAEATLGGEGSLGLDCEPRTGLDFSDLYYLTMNNKHWLVHKEW FHDIPLPWHAGADTGTPHWNNKEALVEFKDAHAKRQTVVVLGSQEGAVHT ALAGALEAEMDGAKGRLSSGHLKCRLKMDKLRLKGVSYSLCTAAFTFTKI PAETLHGTVTVEVQYAGTDGPCKVPAQMAVDMQTLTPVGRLITANPVITE STENSKMMLELDPPFGDSYIVIGVGEKKITHHWHRSGSTIGKAFEATVRG AKRMAVLGDTAWDFGSVGGALNSLGKGIHQIFGAAFKSLFGGMSWFSQIL IGTLLVWLGLNTKNGSISLTCLALGGVLIFLSTAVSA | 117 |
| HuIgG$_k$ signal peptide_prME #1 (Brazil_isolate_ ZikaSPH2015) | METPAQLLFLLLLWLPDTTGVEVTRRGSAYYMYLDRSDAGEAISFPTTLG MNKCYIQIMDLGHMCDATMSYECPMLDEGVEPDDVDCWCNTTSTWVVYGT CHHKKGEARRSRRAVTLPSHSTRKLQTRSQTWLESREYTKHLIRVENWIF RNPGFALAAAAIAWLLGSSTSQKVIYLVMILLIAPAYSIRCIGVSNRDFV EGMSGGTWVDVVLEHGGCVTVMAQDKPAVDIELVTTTVSNMAEVRSYCYE ASISDMASDSRCPTQGEAYLDKQSDTQYVCKRTLVDRGWGNGCGLFGKGS LVTCAKFACSKKMTGKSIQPENLEYRIMLSVHGSQHSGMIVNDTGHETDE NRAKVEITPNSPRAEATLGGEGSLGLDCEPRTGLDFSDLYYLTMNNKHWL VHKEWFHDIPLPWHAGADTGTPHWNNKEALVEFKDAHAKRQTVVVLGSQE GAVHTALAGALEAEMDGAKGRLSSGHLKCRLKMDKLRLKGVSYSLCTAAF TFTKIPAETLHGTVTVEVQYAGTDGPCKVPAQMAVDMQTLTPVGRLITAN PVITESTENSKMMLELDPPFGDSYIVIGVGEKKITHHWHRSGSTIGKAFE ATVRGAKRMAVLGDTAWDFGSVGGALNSLGKGIHQIFGAAFKSLFGGMSW FSQILIGTLLVWLGLNTKNGSISLTCLALGGVLIFLSTAVSA | 118 |
| HuIgG$_k$ signal peptide_prME #2 (Brazil_isolate_ ZikaSPH2015) | METPAQLLELLLLWLPDTTGTRRGSAYYMYLDRSDAGEAISEPTTLGMNK CYIQIMDLGHMCDATMSYECPMLDEGVEPDDVDCWCNTTSTWVVYGTCHH KKGEARRSRRAVTLPSHSTRKLQTRSQTWLESREYTKHLIRVENWIFRNP GFALAAAAIAWLLGSSTSQKVIYLVMILLIAPAYSIRCIGVSNRDFVEGM SGGTWVDVVLEHGGCVTVMAQDKPAVDIELVTTTVSNMAEVRSYCYEASI SDMASDSRCPTQGEAYLDKQSDTQYVCKRTLVDRGWGNGCGLFGKGSLVT CAKFACSKKMTGKSIQPENLEYRIMLSVHGSQHSGMIVNDTGHETDENRA KVEITPNSPRAEATLGGEGSLGLDCEPRTGLDFSDLYYLTMNNKHWLVHK EWFHDIPLPWHAGADTGTPHWNNKEALVEFKDAHAKRQTVVVLGSQEGAV HTALAGALEAEMDGAKGRLSSGHLKCRLKMDKLRLKGVSYSLCTAAFTFT | 119 |

TABLE 32-continued

ZIKV Amino Acid Sequences

| Description | Sequence | SEQ ID NO: |
|---|---|---|
| | KIPAETLHGTVTVEVQYAGTDGPCKVPAQMAVDMQTLTPVGRLITANPVI TESTENSKMMLELDPPFGDSYIVIGVGEKKITHHWHRSGSTIGKAFEATV RGAKRMAVLGDTAWDFGSVGGALNSLGKGIHQIFGAAFKSLFGGMSWFSQ ILIGTLLVWLGLNTKNGSISLTCLALGGVLIFLSTAVSA | |
| HuIgG$_k$ signal peptide_E (Brazil_isolate_ ZikaSPH2015) | METPAQLLFLLLLWLPDTTGIRCIGVSNRDFVEGMSGGTWVDVVLEHGGC VTVMAQDKPAVDIELVTTTVSNMAEVRSYCYEASISDMASDSRCPTQGEA YLDKQSDTQYVCKRTLVDRGWGNGCGLFGKGSLVTCAKFACSKKMTGKSI QPENLEYRIMLSVHGSQHSGMIVNDTGHETDENRAKVEITPNSPRAEATL GGEGSLGLDCEPRTGLDFSDLYYLTMNNKHWLVHKEWFHDIPLPWHAGAD TGTPHWNNKEALVEFKDAHAKRQTVVVLGSQEGAVHTALAGALEAEMDGA KGRLSSGHLKCRLKMDKLRLKGVSYSLCTAAFTFTKIPAETLHGTVTVEV QYAGTDGPCKVPAQMAVDMQTLTPVGRLITANPVITESTENSKMMLELDP PFGDSYIVIGVGEKKITHHWHRSGSTIGKAFEATVRGAKRMAVLGDTAWD FGSVGGALNSLGKGIHQIFGAAFKSLFGGMSWFSQILIGTLLVWLGLNTK NGSISLTCLALGGVLIFLSTAVSA | 120 |
| IgE HC signal peptide_prM-E #2 (ACD75819_ Micronesia) | MDWTWILFLVAAATRVHSTRRGSAYYMYLDRSDAGEAISEPTTLGMNKCY IQIMDLGHMCDATMSYECPMLDEGVEPDDVDCWCNTTSTWVVYGTCHHKK GEARRSRRAVTLPSHSTRKLQTRSQTWLESREYTKHLIRVENWIFRNPGF ALAAAAIAWLLGSSTSQKVIYLVMILLIAPAYSIRCIGVSNRDFVEGMSG GTWVDVVLEHGGCVTVMAQDKPAVDIELVTTTVSNMAEVRSYCYEASISD MASDSRCPTQGEAYLDKQSDTQYVCKRTLVDRGWGNGCGLFGKGSLVTCA KFACSKKMTGKSIQPENLEYRIMLSVHGSQHSGMIVNDTGHETDENRAKV EITPNSPRAEATLGGEGSLGLDCEPRTGLDFSDLYYLTMNNKHWLVHKEW FHDIPLPWHAGADTGTPHWNNKEALVEFKDAHAKRQTVVVLGSQEGAVHT ALAGALEAEMDGAKGRLSSGHLKCRLKMDKLRLKGVSYSLCTAAFTFTKI PAETLHGTVTVEVQYAGTDGPCKVPAQMAVDMQTLTPVGRLITANPVITE STENSKMMLELDPPFGDSYIVIGVGEKKITHHWHRSGSTIGKAFEATVRG AKRMAVLGDTAWDFGSVGGALNSLGKGIHQIFGAAFKSLFGGMSWFSQIL IGTLLVWLGLNTKNGSISLTCLALGGVLIFLSTAVSA | 121 |
| HuIgG$_k$ signal peptide_prME #1, (ACD75819_ Micronesia) | METPAQLLFLLLLWLPDTTGVEVTRRGSAYYMYLDRSDAGEAISFPTTLG MNKCYIQIMDLGHMCDATMSYECPMLDEGVEPDDVDCWCNTTSTWVVYGT CHHKKGEARRSRRAVTLPSHSTRKLQTRSQTWLESREYTKHLIRVENWIF RNPGFALAAAAIAWLLGSSTSQKVIYLVMILLIAPAYSIRCIGVSNRDFV EGMSGGTWVDVVLEHGGCVTVMAQDKPAVDIELVTTTVSNMAEVRSYCYE ASISDMASDSRCPTQGEAYLDKQSDTQYVCKRTLVDRGWGNGCGLFGKGS LVTCAKFACSKKMTGKSIQPENLEYRIMLSVHGSQHSGMIVNDTGHETDE NRAKVEITPNSPRAEATLGGEGSLGLDCEPRTGLDFSDLYYLTMNNKHWL VHKEWFHDIPLPWHAGADTGTPHWNNKEALVEFKDAHAKRQTVVVLGSQE GAVHTALAGALEAEMDGAKGRLSSGHLKCRLKMDKLRLKGVSYSLCTAAF TFTKIPAETLHGTVTVEVQYAGTDGPCKVPAQMAVDMQTLTPVGRLITAN PVITESTENSKMMLELDPPFGDSYIVIGVGEKKITHHWHRSGSTIGKAFE ATVRGAKRMAVLGDTAWDFGSVGGALNSLGKGIHQIFGAAFKSLFGGMSW FSQILIGTLLVWLGLNTKNGSISLTCLALGGVLIFLSTAVSA | 122 |
| HuIgG$_k$ signal peptide_prME #2, (ACD75819_ Micronesia) | METPAQLLELLLLWLPDTTGTRRGSAYYMYLDRSDAGEAISEPTTLGMNK CYIQIMDLGHMCDATMSYECPMLDEGVEPDDVDCWCNTTSTWVVYGTCHH KKGEARRSRRAVTLPSHSTRKLQTRSQTWLESREYTKHLIRVENWIFRNP GFALAAAAIAWLLGSSTSQKVIYLVMILLIAPAYSIRCIGVSNRDFVEGM SGGTWVDVVLEHGGCVTVMAQDKPAVDIELVTTTVSNMAEVRSYCYEASI SDMASDSRCPTQGEAYLDKQSDTQYVCKRTLVDRGWGNGCGLFGKGSLVT CAKFACSKKMTGKSIQPENLEYRIMLSVHGSQHSGMIVNDTGHETDENRA KVEITPNSPRAEATLGGEGSLGLDCEPRTGLDFSDLYYLTMNNKHWLVHK EWFHDIPLPWHAGADTGTPHWNNKEALVEFKDAHAKRQTVVVLGSQEGAV HTALAGALEAEMDGAKGRLSSGHLKCRLKMDKLRLKGVSYSLCTAAFTFT KIPAETLHGTVTVEVQYAGTDGPCKVPAQMAVDMQTLTPVGRLITANPVI TESTENSKMMLELDPPFGDSYIVIGVGEKKITHHWHRSGSTIGKAFEATV RGAKRMAVLGDTAWDFGSVGGALNSLGKGIHQIFGAAFKSLFGGMSWFSQ ILIGTLLVWLGLNTKNGSISLTCLALGGVLIFLSTAVSA | 123 |
| HuIgG$_k$ signal peptide_E, (ACD75819_ Micronesia) | METPAQLLFLLLLWLPDTTGIRCIGVSNRDFVEGMSGGTWVDVVLEHGGC VTVMAQDKPAVDIELVTTTVSNMAEVRSYCYEASISDMASDSRCPTQGEA YLDKQSDTQYVCKRTLVDRGWGNGCGLFGKGSLVTCAKFACSKKMTGKSI QPENLEYRIMLSVHGSQHSGMIVNDTGHETDENRAKVEITPNSPRAEATL GGEGSLGLDCEPRTGLDFSDLYYLTMNNKHWLVHKEWFHDIPLPWHAGAD TGTPHWNNKEALVEFKDAHAKRQTVVVLGSQEGAVHTALAGALEAEMDGA KGRLSSGHLKCRLKMDKLRLKGVSYSLCTAAFTFTKIPAETLHGTVTVEV QYAGTDGPCKVPAQMAVDMQTLTPVGRLITANPVITESTENSKMMLELDP PFGDSYIVIGVGEKKITHHWHRSGSTIGKAFEATVRGAKRMAVLGDTAWD FGSVGGALNSLGKGIHQIFGAAFKSLFGGMSWFSQILIGTLLVWLGLNTK NGSISLTCLALGGVLIFLSTAVSA | 124 |

TABLE 32-continued

ZIKV Amino Acid Sequences

| Description | Sequence | SEQ ID NO: |
|---|---|---|
| $HuIgG_k$ signal peptide | METPAQLLFLLLLWLPDTTG | 125 |
| IgE heavy chain epsilon -1 signal peptide | MDWTWILFLVAAATRVHS | 126 |
| Zika_RIO-U1_JEVsp Zika PRME Strain ascension id: ANG09399 | AEVTRRGSAYYMYLDRNDAGEAISEPTTLGMNKCYIQIMDLGHMCDATMS YECPMLDEGVEPDDVDCWCNTTSTWVVYGTCHHKKGEARRSRRAVTLPSH STRKLQTRSQTWLESREYTKHLIRVENWIFRNPGFALAAAAIAWLLGSST SQKVIYLVMILLIAPAYSIRCIGVSNRDFVEGMSGGTWVDVVLEHGGCVT VMAQDKPTVDIELVTTTVSNMAEVRSYCYEASISDMASDSRCPTQGEAYL DKQSDTQYVCKRTLVDRGWGNGCGLFGKGSLVTCAKFACSKKMTGKSIQP ENLEYRIMLSVHGSQHSGMIVNDTGHETDENRAKVEITPNSPRAEATLGG FGSLGLDCEPRTGLDFSDLYYLTMNNKHWLVHKEWFHDIPLPWHAGADTG TPHWNNKEALVEFKDAHAKRQTVVVLGSQEGAVHTALAGALEAEMDGAKG RLSSGHLKCRLKMDKLRLKGVSYSLCTAAFTFTKIPAETLHGTVTVEVQY AGTDGPCKVPAQMAVDMQTLTPVGRLITANPVITESTENSKMMLELDPPF GDSYIVIGVGEKKITHHWHRSGSTIGKAFEATVRGAKRMAVLGDTAWDFG SVGGALNSLGKGIHQIFGAAFKSLFGGMSWFSQILIGTLLMWLGLNTKNG SISLMCLALGGVLIFLSTAVSA | 127 |
| Japanese encephalitis PRM signal sequence | MLGSNSGQRVVFTILLLLVAPAYS | 128 |
| Zika_RIO-U1_JEVsp Zika PRME Strain ascension id: ANG09399 with JEV PRM signal sequence | MLGSNSGQRVVFTILLLLVAPAYSAEVTRRGSAYYMYLDRNDAGEAISFP TTLGMNKCYIQIMDLGHMCDATMSYECPMLDEGVEPDDVDCWCNTTSTWV VYGTCHHKKGEARRSRRAVTLPSHSTRKLQTRSQTWLESREYTKHLIRVE NWIFRNPGFALAAAAIAWLLGSSTSQKVIYLVMILLIAPAYSIRCIGVSN RDFVEGMSGGTWVDVVLEHGGCVTVMAQDKPTVDIELVTTTVSNMAEVRS YCYEASISDMASDSRCPTQGEAYLDKQSDTQYVCKRTLVDRGWGNGCGLF GKGSLVTCAKFACSKKMTGKSIQPENLEYRIMLSVHGSQHSGMIVNDTGH ETDENRAKVEITPNSPRAEATLGGFGSLGLDCEPRTGLDFSDLYYLTMNN KHWLVHKEWFHDIPLPWHAGADTGTPHWNNKEALVEFKDAHAKRQTVVVL GSQEGAVHTALAGALEAEMDGAKGRLSSGHLKCRLKMDKLRLKGVSYSLC TAAFTFTKIPAETLHGTVTVEVQYAGTDGPCKVPAQMAVDMQTLTPVGRL ITANPVITESTENSKMMLELDPPFGDSYIVIGVGEKKITHHWHRSGSTIG KAFEATVRGAKRMAVLGDTAWDFGSVGGALNSLGKGIHQIFGAAFKSLFG GMSWFSQILIGTLLMWLGLNTKNGSISLMCLALGGVLIFLSTAVSA | 129 |
| Zika_RIO-U1¬_VSVgSp Zika PRME Strain ascension id: ANG09399 | EVTRRGSAYYMYLDRNDAGEAISFPTTLGMNKCYIQIMDLGHMCDATMSY ECPMLDEGVEPDDVDCWCNTTSTWVVYGTCHHKKGEARRSRRAVTLPSHS TRKLQTRSQTWLESREYTKHLIRVENWIFRNPGFALAAAAIAWLLGSSTS QKVIYLVMILLIAPAYSIRCIGVSNRDFVEGMSGGTWVDVVLEHGGCVTV MAQDKPTVDIELVTTTVSNMAEVRSYCYEASISDMASDSRCPTQGEAYLD KQSDTQYVCKRTLVDRGWGNGCGLFGKGSLVTCAKFACSKKMTGKSIQPE NLEYRIMLSVHGSQHSGMIVNDTGHETDENRAKVEITPNSPRAEATLGGF GSLGLDCEPRTGLDFSDLYYLTMNNKHWLVHKEWFHDIPLPWHAGADTGT PHWNNKEALVEFKDAHAKRQTVVVLGSQEGAVHTALAGALEAEMDGAKGR LSSGHLKCRLKMDKLRLKGVSYSLCTAAFTFTKIPAETLHGTVTVEVQYA GTDGPCKVPAQMAVDMQTLTPVGRLITANPVITESTENSKMMLELDPPFG DSYIVIGVGEKKITHHWHRSGSTIGKAFEATVRGAKRMAVLGDTAWDFGS VGGALNSLGKGIHQIFGAAFKSLFGGMSWFSQILIGTLLMWLGLNTKNGS ISLMCLALGGVLIFLSTAVSA | 130 |
| VSV g protein signal sequence | MKCLLYLAFLFIGVNCA | 131 |
| Zika_RIO-U1¬_VSVgSp Zika PRME Strain ascension id: ANG09399 with VSV g protein signal sequence | MKCLLYLAFLFigVNCAEVTRRGSAYYMYLDRNDAGEAISFPTTLGMNKC YIQIMDLGHMCDATMSYECPMLDEGVEPDDVDCWCNTTSTWVVYGTCHHK KGEARRSRRAVTLPSHSTRKLQTRSQTWLESREYTKHLIRVENWIFRNPG FALAAAAIAWLLGSSTSQKVIYLVMILLIAPAYSIRCIGVSNRDFVEGMS GGTWVDVVLEHGGCVTVMAQDKPTVDIELVTTTVSNMAEVRSYCYEASIS DMASDSRCPTQGEAYLDKQSDTQYVCKRTLVDRGWGNGCGLFGKGSLVTC AKFACSKKMTGKSIQPENLEYRIMLSVHGSQHSGMIVNDTGHETDENRAK VEITPNSPRAEATLGGFGSLGLDCEPRTGLDFSDLYYLTMNNKHWLVHKE WFHDIPLPWHAGADTGTPHWNNKEALVEFKDAHAKRQTVVVLGSQEGAVH TALAGALEAEMDGAKGRLSSGHLKCRLKMDKLRLKGVSYSLCTAAFTFTK IPAETLHGTVTVEVQYAGTDGPCKVPAQMAVDMQTLTPVGRLITANPVIT ESTENSKMMLELDPPFGDSYIVIGVGEKKITHHWHRSGSTIGKAFEATVR GAKRMAVLGDTAWDFGSVGGALNSLGKGIHQIFGAAFKSLFGGMSWFSQI LIGTLLMWLGLNTKNGSISLMCLALGGVLIFLSTAVSA | 132 |

TABLE 32-continued

| ZIKV Amino Acid Sequences | | |
|---|---|---|
| Description | Sequence | SEQ ID NO: |
| ZIKA_PRME_DSP_ N154A (glycosylation mutant) Zika PRME Strain ascension id: ACD75819 | VEVTRRGSAYYMYLDRSDAGEAISFPTTLGMNKCYIQIMDLGHMCDATMS YECPMLDEGVEPDDVDCWCNTTSTWVVYGTCHHKKGEARRSRRAVTLPSH STRKLQTRSQTWLESREYTKHLIRVENWIFRNPGFALAAAAIAWLLGSST SQKVIYLVMILLIAPAYSIRCIGVSNRDFVEGMSGGTWVDVVLEHGGCVT VMAQDKPAVDIELVTTTVSNMAEVRSYCYEASISDMASDSRCPTQGEAYL DKQSDTQYVCKRTLVDRGWGNGCGLFGKGSLVTCAKFACSKKMTGKSIQP ENLEYRIMLSVHGSQHSGMIVADTGHETDENRAKVEITPNSPRAEATLGG FGSLGLDCEPRTGLDFSDLYYLTMNNKHWLVHKEWFHDIPLPWHAGADTG TPHWNNKEALVEFKDAHAKRQTVVVLGSQEGAVHTALAGALEAEMDGAKG RLSSGHLKCRLKMDKLRLKGVSYSLCTAAFTFTKIPAETLHGTVTVEVQY AGTDGPCKVPAQMAVDMQTLTPVGRLITANPVITESTENSKMMLELDPPF GDSYIVIGVGEKKITHHWHRSGSTIGKAFEATVRGAKRMAVLGDTAWDFG SVGGALNSLGKGIHQIFGAAFKSLFGGMSWFSQILIGTLLVWLGLNTKNG SISLTCLALGGVLIFLSTAVSA | 133 |
| ZIKA_PRME_DSP_ N154A (glycosylation mutant with signal peptide) Zika PRME Strain ascension id: ACD75819 with IgE signal peptide | MDWTWILFLVAAATRVHSVEVTRRGSAYYMYLDRSDAGEAISEPTTLGMN KCYIQIMDLGHMCDATMSYECPMLDEGVEPDDVDCWCNTTSTWVVYGTCH HKKGEARRSRRAVTLPSHSTRKLQTRSQTWLESREYTKHLIRVENWIFRN PGFALAAAAIAWLLGSSTSQKVIYLVMILLIAPAYSIRCIGVSNRDFVEG MSGGTWVDVVLEHGGCVTVMAQDKPAVDIELVTTTVSNMAEVRSYCYEAS ISDMASDSRCPTQGEAYLDKQSDTQYVCKRTLVDRGWGNGCGLFGKGSLV TCAKFACSKKMTGKSIQPENLEYRIMLSVHGSQHSGMIVADTGHETDENR AKVEITPNSPRAEATLGGEGSLGLDCEPRTGLDFSDLYYLTMNNKHWLVH KEWFHDIPLPWHAGADTGTPHWNNKEALVEFKDAHAKRQTVVVLGSQEGA VHTALAGALEAEMDGAKGRLSSGHLKCRLKMDKLRLKGVSYSLCTAAFTF TKIPAETLHGTVTVEVQYAGTDGPCKVPAQMAVDMQTLTPVGRLITANPV ITESTENSKMMLELDPPFGDSYIVIGVGEKKITHHWHRSGSTIGKAFEAT VRGAKRMAVLGDTAWDFGSVGGALNSLGKGIHQIFGAAFKSLFGGMSWFS QILIGTLLVWLGLNTKNGSISLTCLALGGVLIFLSTAVSA | 134 |

TABLE 33

| ZIKV NCBI Accession Numbers (Amino Acid Sequences) | |
|---|---|
| Name | GenBank Accession |
| polyprotein [Zika virus] | YP_002790881.1 |
| polyprotein [Zika virus] | BAP47441.1 |
| polyprotein [Zika virus] | AEN75263.1 |
| polyprotein [Zika virus] | AHL43504.1 |
| polyprotein [Zika virus] | AEN75266.1 |
| polyprotein [Zika virus] | AHF49784.1 |
| polyprotein [Zika virus] | AHF49783.1 |
| polyprotein [Zika virus] | AHF49785.1 |
| polyprotein [Zika virus] | ABI54475.1 |
| polyprotein [Zika virus] | AHL43501.1 |
| polyprotein [Zika virus] | AHL43500.1 |
| polyprotein [Zika virus] | AHL43502.1 |
| polyprotein [Zika virus] | AEN75265.1 |
| polyprotein [Zika virus] | AHL43503.1 |
| polyprotein [Zika virus] | AEN75264.1 |
| polyprotein [Zika virus] | AHZ13508.1 |
| polyprotein [Zika virus] | ACD75819.1 |
| polyprotein [Zika virus] | AFD30972.1 |
| polyprotein [Zika virus] | AAK91609.1 |
| envelope protein [Zika virus] | AHL43462.1 |
| envelope protein [Zika virus] | AHL43464.1 |
| envelope protein [Zika virus] | AHL43461.1 |
| envelope protein [Zika virus] | AHL43460.1 |
| envelope protein [Zika virus] | AHL43463.1 |
| envelope protein [Zika virus] | AHL43444.1 |
| envelope protein [Zika virus] | AHL43451.1 |
| envelope protein [Zika virus] | AHL43437.1 |
| envelope protein [Zika virus] | AHL43455.1 |
| envelope protein [Zika virus] | AHL43448.1 |
| envelope protein [Zika virus] | AHL43439.1 |
| envelope protein [Zika virus] | AHL43468.1 |
| E protein [Zika virus] | AIC06934.1 |
| envelope protein [Zika virus] | AHL43450.1 |
| envelope protein [Zika virus] | AHL43442.1 |
| envelope protein [Zika virus] | AHL43458.1 |

TABLE 33-continued

| ZIKV NCBI Accession Numbers (Amino Acid Sequences) | |
|---|---|
| Name | GenBank Accession |
| envelope glycoprotein [Zika virus] | AHL16749.1 |
| envelope protein [Zika virus] | AHL43453.1 |
| envelope protein [Zika virus] | AHL43443.1 |
| envelope protein [Zika virus] | AHL43438.1 |
| envelope protein [Zika virus] | AHL43441.1 |
| envelope protein [Zika virus] | AHL43457.1 |
| envelope protein [Zika virus] | AAK91609.1 |
| polyprotein [Zika virus] | AHL43505.1 |

Example 35: Surface Expressed DENV2 prME Antigens

Figure 34A:
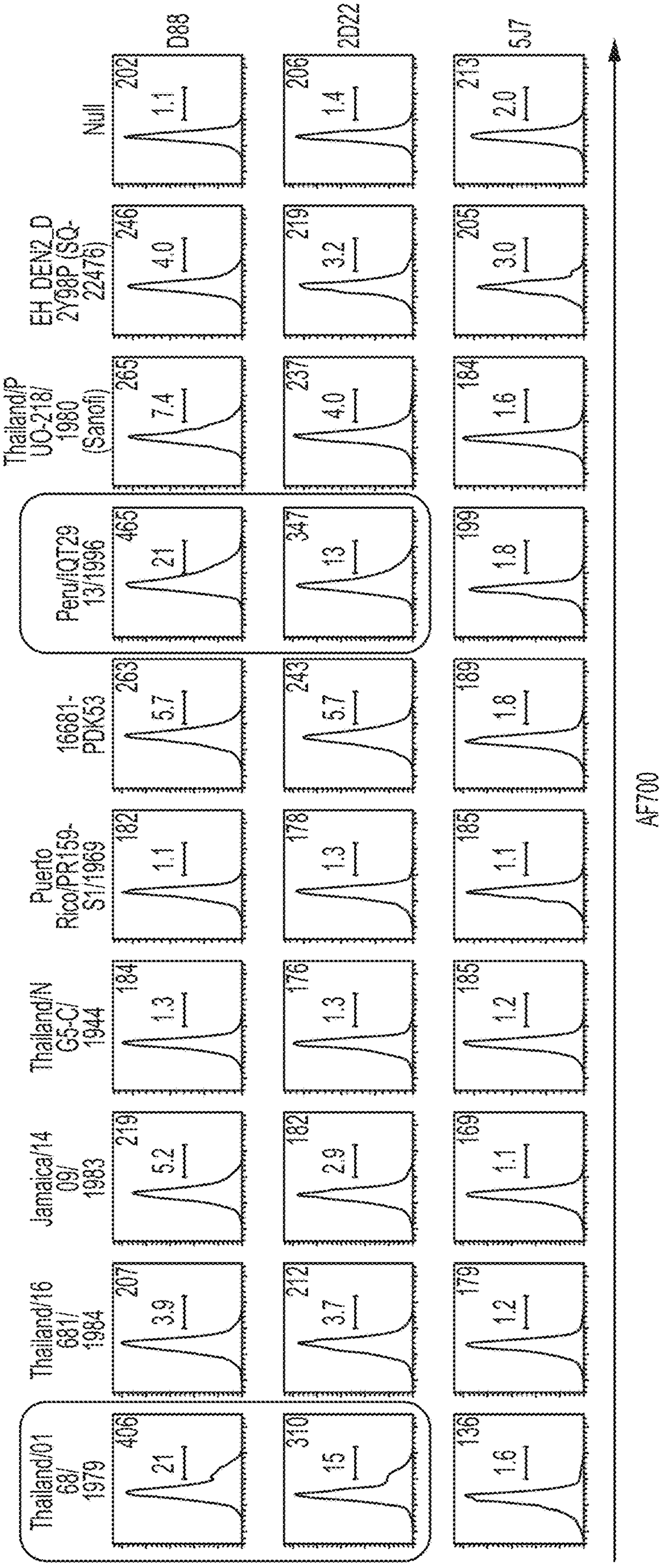
FIG. 34A shows FACS analyses of cells expressing DENV2 prMEs using different antibodies against Dengue envelope protein. Numbers in the upper right corner of each plot indicate mean fluorescent intensity.
Figure 34B:
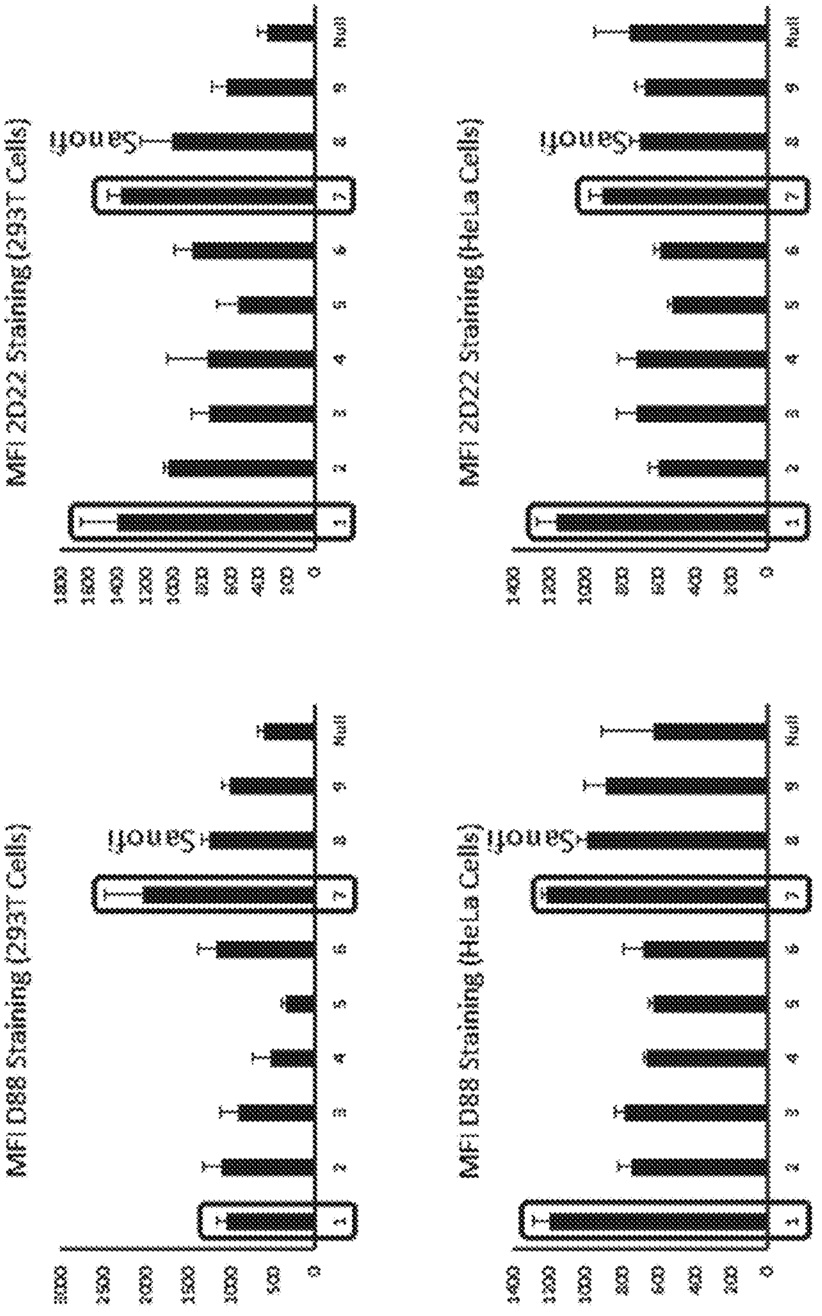
FIG. 34B shows a repeat of staining in triplicate and in two different cell lines (HeLa and 293T).

The DENV2 prME polypeptide antigen sequences provided in Table 34 were tested to confirm that the DENV prME protein antigen is translated, properly folded and expressed on the surface of cells. For the polypeptide sequences, the bolded sequence is Dengue signal sequence, the underlined sequence is DENV2 precursor membrane sequence, and the unmarked sequence is DENV2 envelope sequence. The sequences encoding the polypeptides are codon-optimized. HeLa cells were transfected with DNA encoding the prMEs from nine different Dengue 2 isolates. After 24 hours, surface expression of the prME was detected using three different antibodies followed by goat-anti-human AF700 secondary antibody and subjecting the cells to FACS analyses. Each of the three antibodies are broadly neutralizing DENV2 prME antibodies that have in vivo efficacy against Dengue virus. D88 binds to DIII of Envelope protein for all 4 Dengue serotypes (US20150225474). 2D22 binds to DIII of Envelope protein for Dengue 2 serotype. 5J7 binds to 3 domains of Envelope protein for Dengue 3 serotype. FIG. 34B shows that two of the DENV2 prME antigens are recognized by the D88 and 2D22 antibodies. These results show that the two DENV2 prME antigens identified as Thailand/01 68/1979 and Peru/IQT29 13/1996 are expressed at the cell surface in a conformationally correct form and are excellent vaccine candidates (FIG. 34A). FIG. 34B shows a repeat of staining in triplicate and in two different cell lines (HeLa and 293T). These results confirm proper conformation of expressed DENV2 prME antigens (in particular, the prME antigens from Thailand/01 68/1979 and Peru/IQT29 13/1996) and also evidence at least non-inferior and even superior DENV2 antigenicity as compared to Dengvaxia (CYD-TDV), a live attenuated tetravalent chimeric vaccine. Antigen expressed from the mRNA encoding Dengue 2 prME from Peru/IQT2913/1996 shows the best binding to 2 different DENV2 antibodies in 293T cells and in HeLa cells (D88—binds all 4 serotypes 2D22—binds Dengue 2). This construct has a single amino acid difference from the Dengue 2 Envelope III Domain immunodeterminant region (see bold, underline in SEQ ID NO: 168, Table 34).

TABLE 34

Example DENV2 PrME Polypeptide

| Sequence Name | 5' UTR | ORF | 3' UTR | Polypeptide Sequence |
|---|---|---|---|---|
| Dengue 2<br>prME<br>(Thailand/<br>0168/1979) | TCAAGCTT<br>TTGGACCC<br>TCGTACAG<br>AAGCTAAT<br>ACGACTCA<br>CTATAGGG<br>AAATAAGA<br>GAGAAAAG<br>AAGAGTAA<br>GAAGAAAT<br>ATAAGAGC<br>CACC<br>(SEQ ID<br>NO: 135) | ATGCTGAATATTCTGAACCGCCG<br>CCGCCGGACTGCCGGGATTATAA<br>TTATGATGATTCCCACCGTGATG<br>GCCTTCCACCTGACCACCCGGAA<br>CGGGGAACCACATATGATCGTGT<br>CCAGACAGGAGAAGGGAAAGTCC<br>CTGCTGTTCAAGACCGAGGACGG<br>CGTGAACATGTGCACCCTCATGG<br>CTATGGACCTGGGCGAACTCTGC<br>GAGGACACCATCACCTACAAGTG<br>CCCCCTGTTGAGGCAGAACGAGC<br>CGGAGGATATTGACTGCTGGTGC<br>AATTCGACCAGCACCTGGGTCAC<br>CTACGGGACTTGCACCACAACCG<br>GAGAACATCGGCGCGAAAAGCGC<br>AGCGTGGCTTTGGTGCCTCACGT<br>CGGAATGGGGCTGGAGACTAGAA<br>CCGAGACTTGGATGTCGTCGGAA<br>GGGGCCTGGAAACACGCACAGCG<br>CATCGAAACTTGGATACTCAGGC<br>ATCCCGGCTTCACCATTATGGCC<br>GCGATCCTGGCATACACCATCGG<br>TACTACCCACTTCCAACGGGCCC<br>TGATCTTTATCCTCCTGACCGCT<br>GTCGCACCATCCATGACCATGCG<br>GTGTATCGGTATCAGCAACAGGG<br>ACTTCGTGGAGGGAGTGTCGGGA<br>GGATCCTGGGTGGATATTGTGCT<br>GGAACACGGTTCCTGCGTCACTA<br>CCATGGCGAAGAACAAGCCTACC<br>CTGGACTTTGAGCTGATCAAAAC<br>TGAGGCCAAGCAGCCGGCCACCC<br>TGCGCAAGTACTGCATCGAAGCC<br>AAGCTGACCAATACCACTACCGA<br>ATCCCGCTGTCCGACCCAAGGGG<br>AGCCCTCCCTGAATGAGGAGCAG<br>GACAAGCGCTTCGTCTGCAAGCA<br>TTCAATGGTCGACCGCGGCTGGG<br>GAAACGGCTGCGGACTGTTCGGA<br>AAGGGCGGCATTGTGACCTGTGC<br>CATGTTCACTTGCAAGAAGAACA<br>TGGAAGGAAAGATCGTGCAGCCC<br>GAAAACCTGGAGTATACCATCGT<br>CGTGACCCCGCACTCCGGGGAAG<br>AACACGCTGTGGGAAACGACACC<br>GGAAAGCACGGAAAGGAGATCAA<br>AGTGACCCCACAGTCGAGCATTA<br>CCGAGGCCGAACTTACTGGTTAC<br>GGCACTGTGACGATGGAATGTTC<br>ACCGAGAACTGGACTGGATTTCA<br>ACGAAATGGTGCTGCTCCAAATG<br>GAAAACAAGGCCTGGCTGGTGCA<br>CCGCCAGTGGTTTCTTGACCTCC<br>CTCTCCCTTGGCTGCCTGGAGCA<br>GACACTCAGGGTTCCAACTGGAT<br>TCAGAAGGAAACACTCGTGACCT<br>TCAAGAACCCTCACGCGAAGAAG<br>CAGGATGTGGTCGTGCTGGGAAG<br>CCAGGAGGGAGCGATGCATACCG<br>CCCTCACCGGCGCGACGGAGATT | TGATAATA<br>GGCTGGAG<br>CCTCGGTG<br>GCCATGCT<br>TCTTGCCC<br>CTTGGGCC<br>TCCCCCCA<br>GCCCCTCC<br>TCCCCTTC<br>CTGCACCC<br>GTACCCCC<br>GTGGTCTT<br>TGAATAAA<br>GTCTGAGT<br>GGGCGGC<br>(SEQ ID<br>NO: 153) | **MLNILNRRRRTA**<br>**GIIIMMIPTVMA**<br>FHLTTRNGEPHM<br>IVSRQEKGKSLL<br>FKTEDGVNMCTL<br>MAMDLGELCEDT<br>ITYKCPLLRQNE<br>PEDIDCWCNSTS<br>TWVTYGTCTTTG<br>EHRREKRSVALV<br>PHVGMGLETRTE<br>TWMSSEGAWKHA<br>QRIETWILRHPG<br>FTIMAAILAYTI<br>GTTHFQRALIFI<br>LLTAVAPSMTMR<br>CIGISNRDFVEG<br>VSGGSWVDIVLE<br>HGSCVTTMAKNK<br>PTLDFELIKTEA<br>KQPATLRKYCIE<br>AKLTNTTTESRC<br>PTQGEPSLNEEQ<br>DKRFVCKHSMVD<br>RGWGNGCGLFGK<br>GGIVTCAMFTCK<br>KNMEGKIVQPEN<br>LEYTIVVTPHSG<br>EEHAVGNDTGKH<br>GKEIKVTPQSSI<br>TEAELTGYGTVT<br>MECSPRTGLDFN<br>EMVLLQMENKAW<br>LVHRQWFLDLPL<br>PWLPGADTQGSN<br>WIQKETLVTFKN<br>PHAKKQDVVVLG<br>SQEGAMHTALTG<br>ATEIQMSSGNLL<br>FTGHLKCRLRMD<br>KLQLKGMSYSMC<br>TGKFKVVKEIAE<br>TQHGTIVIRVQY<br>EGDGSPCKIPFE<br>IMDLEKRHVLGR<br>LITVNPIVTEKD<br>SPVNIEAEPPFG<br>DSYIIIGVEPGQ<br>LKLNWFKKGSSI<br>GQMFETTMRGAK<br>RMAILGDTAWDF<br>GSLGGVFTSIGK<br>ALHQVFGAIYGA<br>AFSGVSWTMKIL<br>IGVIITWIGMNS<br>RSTSLSVSLVLV<br>GIVTLYLGVMVQ<br>A (SEQ ID<br>NO: 162) |

TABLE 34-continued

Example DENV2 PrME Polypeptide

| Sequence Name | 5' UTR | ORF | 3' UTR | Polypeptide Sequence |
|---|---|---|---|---|
| | | CAGATGTCCAGCGGAAACCTTCT | | |
| | | GTTCACCGGACACCTGAAGTGCA | | |
| | | GACTGAGGATGGACAAGCTGCAG | | |
| | | CTCAAGGGAATGTCCTACTCCAT | | |
| | | GTGCACTGGAAAGTTCAAGGTCG | | |
| | | TGAAGGAGATTGCCGAAACTCAG | | |
| | | CATGGTACCATCGTGATCCGGGT | | |
| | | GCAATATGAAGGGGACGGATCCC | | |
| | | CGTGCAAGATCCCTTTCGAAATC | | |
| | | ATGGACTTGGAGAAGCGACACGT | | |
| | | GCTGGGCAGACTGATCACAGTCA | | |
| | | ACCCCATCGTGACTGAGAAGGAT | | |
| | | TCACCCGTGAACATTGAAGCCGA | | |
| | | GCCGCCTTTCGGCGATAGCTACA | | |
| | | TCATCATTGGCGTGGAACCGGGA | | |
| | | CAGCTTAAGCTCAACTGGTTCAA | | |
| | | GAAGGGTTCCTCGATCGGTCAAA | | |
| | | TGTTTGAAACCACGATGCGGGGT | | |
| | | GCCAAACGGATGGCCATTCTGGG | | |
| | | AGACACCGCCTGGGATTTCGGCT | | |
| | | CCTTGGGCGGAGTGTTCACTTCT | | |
| | | ATCGGAAAGGCGCTGCACCAAGT | | |
| | | GTTCGGAGCCATCTACGGCGCCG | | |
| | | CGTTCTCGGGCGTCAGCTGGACC | | |
| | | ATGAAGATTCTGATCGGGGTCAT | | |
| | | CATCACTTGGATTGGGATGAACT | | |
| | | CACGGTCCACCTCCCTGAGCGTG | | |
| | | TCCCTTGTCCTGGTCGGCATCGT | | |
| | | GACCCTGTACCTCGGAGTGATGG | | |
| | | TGCAGGCTTAG (SEQ ID NO: | | |
| | | 144) | | |
| Dengue 2 | TCAAGCTT | ATGCTTAACATTCTCAACCGCCG | TGATAATA | **MLNILNRRRRTA** |
| prME | TTGGACCC | CCGGAGAACTGCTGGTATTATCA | GGCTGGAG | **GIIIMMIPTVMA** |
| (Thailand/ | TCGTACAG | TTATGATGATTCCCACTGTGATG | CCTCGGTG | FHLTTRNGEPHM |
| 16681/1984) | AAGCTAAT | GCCTTCCACCTGACCACGCGGAA | GCCATGCT | IVGRQEKGKSLL |
| | ACGACTCA | CGGCGAACCCCATATGATTGTCG | TCTTGCCC | FKTEDGVNMCTL |
| | CTATAGGG | GTCGGCAGGAAAAGGGGAAGTCC | CTTGGGCC | MAIDLGELCEDT |
| | AAATAAGA | CTGCTGTTCAAAACTGAGGACGG | TCCCCCCA | ITYKCPLLRQNE |
| | GAGAAAAG | AGTGAACATGTGCACCCTCATGG | GCCCCTCC | PEDIDCWCNSTS |
| | AAGAGTAA | CTATTGACCTGGGAGAGCTGTGC | TCCCCTTC | TWVTYGTCATTG |
| | GAAGAAAT | GAAGATACTATCACGTACAAGTG | CTGCACCC | EHRREKRSVALV |
| | ATAAGAGC | CCCCCTGCTGCGCCAGAACGAGC | GTACCCCC | PHVGMGLETRTE |
| | CACC | CTGAGGACATTGACTGCTGGTGC | GTGGTCTT | TWMSSEGAWKHV |
| | (SEQ ID | AACTCCACGTCAACCTGGGTCAC | TGAATAAA | QRIETWILRHPG |
| | NO: 136) | CTACGGAACTTGCGCGACTACCG | GTCTGAGT | FTIMAAILAYTI |
| | | GCGAACATCGCAGAGAAAAGAGA | GGGCGGC | GTTHFQRALIFI |
| | | AGCGTGGCCCTCGTGCCGCACGT | (SEQ ID | LLTAVAPSMTMR |
| | | CGGGATGGGGCTGGAAACCCGGA | NO: 154) | CIGMSNRDFVEG |
| | | CCGAAACCTGGATGTCCTCGGAA | | VSGGSWVDIVLE |
| | | GGCGCCTGGAAGCACGTGCAGAG | | HGSCVTTMAKNK |
| | | GATCGAAACTTGGATCCTCCGGC | | PTLDFELIKTEA |
| | | ACCCGGGATTCACCATCATGGCC | | KQPATLRKYCIE |
| | | GCCATCCTCGCTTACACAATCGG | | AKLTNTTTESRC |
| | | AACCACTCACTTTCAACGCGCCC | | PTQGEPSLNEEQ |
| | | TGATCTTCATCCTGCTTACCGCC | | DKRFVCKHSMVD |
| | | GTGGCCCCGTCCATGACCATGCG | | RGWGNGCGLFGK |
| | | CTGCATTGGAATGTCAAACCGGG | | GGIVTCAMFRCK |
| | | ACTTCGTCGAGGGAGTCTCCGGA | | KNMEGKVVQPEN |
| | | GGAAGCTGGGTGGACATCGTGCT | | LEYTIVITPHSG |
| | | GGAGCACGGCAGCTGTGTGACCA | | EEHAVGNDTGKH |
| | | CCATGGCCAAGAACAAGCCAACT | | GKEIKITPQSST |
| | | CTTGATTTCGAACTGATCAAGAC | | TEAELTGYGTVT |
| | | CGAGGCCAAGCAGCCTGCCACTC | | MECSPRTGLDFN |
| | | TGAGGAAGTACTGTATCGAAGCG | | EMVLLQMENKAW |
| | | AAGCTGACCAACACCACTACCGA | | LVHRQWFLDLPL |
| | | ATCCCGCTGCCCGACCCAGGGCG | | PWLPGADTQGSN |
| | | AACCTTCCTTGAACGAAGAACAG | | WIQKETLVTFKN |
| | | GACAAGAGATTCGTGTGCAAGCA | | PHAKKQDVVVLG |
| | | TAGCATGGTCGACAGGGGATGGG | | SQEGAMHTALTG |
| | | GGAACGGATGTGGACTCTTTGGG | | ATEIQMSSGNLL |
| | | AAGGGCGGAATCGTCACCTGTGC | | FTGHLKCRLRMD |
| | | GATGTTCCGGTGCAAGAAGAACA | | KLQLKGMSYSMC |
| | | TGGAGGGGAAGGTCGTGCAGCCC | | TGKFKVVKEIAE |
| | | GAAAATCTCGAGTACACTATCGT | | TQHGTIVIRVQY |

TABLE 34-continued

| Example DENV2 PrME Polypeptide | | | | |
|---|---|---|---|---|
| Sequence Name | 5' UTR | ORF | 3' UTR | Polypeptide Sequence |
| | | GATCACCCCGCATTCCGGAGAGG<br>AGCACGCCGTGGGCAACGACACC<br>GGGAAGCACGGAAAGGAGATCAA<br>AATTACCCCTCAATCCTCCACCA<br>CCGAAGCCGAATTGACTGGTTAC<br>GGTACCGTGACTATGGAGTGCTC<br>GCCGCGGACTGGCTTGGACTTCA<br>ACGAGATGGTGCTGCTGCAAATG<br>GAGAACAAGGCCTGGCTGGTGCA<br>CCGGCAGTGGTTTCTTGATCTGC<br>CTCTGCCTTGGCTGCCCGGAGCC<br>GACACCCAGGGTAGCAATTGGAT<br>CCAGAAAGAGACACTCGTGACCT<br>TTAAGAACCCGCACGCAAAGAAG<br>CAGGATGTCGTGGTCCTGGGAAG<br>CCAAGAAGGGGCAATGCATACCG<br>CACTCACTGGAGCCACTGAAATC<br>CAGATGTCCTCCGGCAATCTGCT<br>GTTCACCGGCCATCTGAAGTGCC<br>GACTGCGCATGGACAAGCTCCAG<br>CTTAAGGGAATGTCCTACTCCAT<br>GTGTACTGGAAAGTTCAAAGTCG<br>TGAAGGAAATTGCCGAAACCCAG<br>CACGGCACCATAGTGATCCGGGT<br>GCAGTACGAGGGCGACGGCTCAC<br>CCTGCAAAATCCCGTTCGAGATT<br>ATGGATCTCGAAAAGCGCCACGT<br>GCTGGGCAGACTGATTACCGTGA<br>ACCCTATCGTGACCGAGAAGGAT<br>TCCCCAGTGAACATCGAGGCCGA<br>ACCGCCCTTCGGAGACTCGTATA<br>TCATCATCGGCGTGGAGCCCGGC<br>CAGCTGAAGCTGAACTGGTTCAA<br>GAAGGGGTCGAGCATCGGCCAGA<br>TGTTCGAGACTACCATGCGCGGC<br>GCGAAGAGGATGGCGATCCTGGG<br>GGATACCGCTTGGGACTTCGGTT<br>CCCTCGGCGGGGTGTTCACCTCG<br>ATTGGGAAGGCCCTCCACCAAGT<br>GTTCGGTGCAATCTACGGAGCGG<br>CGTTCAGCGGAGTGTCGTGGACC<br>ATGAAGATTCTGATCGGCGTGAT<br>CATCACCTGGATTGGCATGAACT<br>CCCGGTCTACTAGCCTGTCGGTG<br>ACCCTGGTGCTGGTCGGAATCGT<br>GACCTTGTACCTGGGAGTGATGG<br>TGCAAGCTTAG (SEQ ID NO: 145) | | EGDGSPCKIPFE<br>IMDLEKRHVLGR<br>LITVNPIVTEKD<br>SPVNIEAEPPFG<br>DSYIIIGVEPGQ<br>LKLNWFKKGSSI<br>GQMFETTMRGAK<br>RMAILGDTAWDF<br>GSLGGVFTSIGK<br>ALHQVFGAIYGA<br>AFSGVSWTMKIL<br>IGVIITWIGMNS<br>RSTSLSVTLVLV<br>GIVTLYLGVMVQ<br>A (SEQ ID NO: 163) |
| Dengue 2 prME (Jamaica/ 1409/1983) | TCAAGCTT<br>TTGGACCC<br>TCGTACAG<br>AAGCTAAT<br>ACGACTCA<br>CTATAGGG<br>AAATAAGA<br>GAGAAAAG<br>AAGAGTAA<br>GAAGAAAT<br>ATAAGAGC<br>CACC<br>(SEQ ID NO: 137) | ATGCTGAACATCCTGAACCGCAG<br>AAGGAGAACCGCCGGTATTATTA<br>TTATGATGATCCCCACCGTGATG<br>GCATTCCACCTGACTACCCGCAA<br>CGGAGAGCCGCATATGATCGTGG<br>GCCGCCAGGAAAAGGGAAAGTCC<br>CTGCTGTTCAAGACTGAGGACGG<br>CGTGAACATGTGCACTCTCATGG<br>CCATCGACCTCGGCGAACTGTGC<br>GAGGACACCATTACTTACAAGTG<br>CCCGCTGCTGAGACAGAACGAGC<br>CTGAGGACATCGACTGTTGGTGT<br>AACTCGACCTCCACCTGGGTCAC<br>CTACGGAACGTGCGCCACAACCG<br>GAGAACACCGCCGGGAAAAGCGG<br>AGCGTGGCTCTGGTGCCGCACGT<br>CGGAATGGGTCTGGAGACTAGAA<br>CCGAAACCTGGATGTCATCCGAG<br>GGGGCATGGAAACATGTGCAGCG<br>AATCGAGACTTGGATCCTGAGAC<br>ACCCGGGCTTCACTATCATGGCG<br>GCCATCCTTGCCTACACCATTGG<br>CACTACTCACTTCCAACGGGCGC<br>TGATCTTCATACTGCTCACCGCG<br>GTGGCCCCCTCCATGACGATGCG<br>CTGCATCGGAATCTCCAACCGGG | TGATAATA<br>GGCTGGAG<br>CCTCGGTG<br>GCCATGCT<br>TCTTGCCC<br>CTTGGGCC<br>TCCCCCCA<br>GCCCCTCC<br>TCCCCTTC<br>CTGCACCC<br>GTACCCCC<br>GTGGTCTT<br>TGAATAAA<br>GTCTGAGT<br>GGGCGGC<br>(SEQ ID NO: 155) | **MLNILNRRRRTA**<br>**GIIIMMIPTVMA**<br>FHLTTRNGEPHM<br>IVGRQEKGKSLL<br>FKTEDGVNMCTL<br>MAIDLGELCEDT<br>ITYKCPLLRQNE<br>PEDIDCWCNSTS<br>TWVTYGTCATTG<br>EHRREKRSVALV<br>PHVGMGLETRTE<br>TWMSSEGAWKHV<br>QRIETWILRHPG<br>FTIMAAILAYTI<br>GTTHFQRALIFI<br>LLTAVAPSMTMR<br>CIGISNRDFVEG<br>VSGGSWVDIVLE<br>HGSCVTTMAKNK<br>PTLDFELIKTEA<br>KQPATLRKYCIE<br>AKLTNTTTESRC<br>PTQGEPSLNEEQ<br>DKRFLCKHSMVD<br>RGWGNGCGLFGK<br>GGIVTCAMFTCK |

TABLE 34-continued

Example DENV2 PrME Polypeptide

| Sequence Name | 5' UTR | ORF | 3' UTR | Polypeptide Sequence |
|---|---|---|---|---|
| | | ACTTCGTGGAGGGCGTCAGCGGA | | KNMEGKVVLPEN |
| | | GGCAGCTGGGTGGACATCGTGTT | | LEYTIVITPHSG |
| | | GGAGCACGGAAGCTGCGTGACCA | | EEHAVGNDTGKH |
| | | CCATGGCCAAGAACAAGCCCACT | | GKEIKITPQSSI |
| | | CTTGATTTTGAGCTGATCAAGAC | | TEAELTGYGTVT |
| | | GGAAGCAAAGCAGCCGGCCACTC | | MECSPRTGLDFN |
| | | TGAGGAAGTACTGCATCGAGGCC | | EMVLLQMEDKAW |
| | | AAGCTCACCAACACAACCACCGA | | LVHRQWFLDLPL |
| | | ATCTCGGTGCCCGACCCAAGGAG | | PWLPGADTQGSN |
| | | AGCCATCACTGAACGAGGAACAG | | WIQKETLVTFKN |
| | | GACAAGAGATTCCTGTGCAAACA | | PHAKKQDVVVLG |
| | | TTCGATGGTGGACAGGGGATGGG | | SQEGAMHTALTG |
| | | GAAATGGTTGCGGCCTGTTCGGC | | ATEIQMSSGNLL |
| | | AAAGGAGGCATTGTGACCTGTGC | | FTGHLKCRLRMD |
| | | GATGTTCACTTGCAAGAAAAACA | | KLQLKGMSYSMC |
| | | TGGAGGGGAAGGTCGTGTTGCCG | | TGKFKIVKEIAE |
| | | GAGAACCTGGAGTACACTATCGT | | TQHGTIVIRVQY |
| | | GATTACCCCGCACTCCGGGGAGG | | EGDGSPCKIPFE |
| | | AACATGCCGTGGGAAATGACACC | | IMDLEKRHVLGR |
| | | GGAAAGCACGGGAAGGAAATCAA | | LITVNPIVTEKD |
| | | AATCACGCCTCAGTCCTCAATCA | | SPVNIEAEPPFG |
| | | CCGAAGCCGAGCTTACCGGCTAC | | DSYIIIGVEPGQ |
| | | GGTACCGTGACCATGGAGTGCAG | | LKLNWFKKGSSI |
| | | CCCTCGGACTGGACTGGACTTCA | | GQMFETTMRGAK |
| | | ACGAGATGGTGCTGCTGCAAATG | | RMAILGDTAWDF |
| | | GAAGATAAGGCCTGGCTGGTGCA | | GSLGGVFTSIGK |
| | | CCGGCAGTGGTTCTTGGATTTGC | | ALHQVFGAIYGA |
| | | CACTGCCTTGGCTGCCCGGCGCG | | AFSGVSWTMKIL |
| | | GATACCCAGGGTTCCAACTGGAT | | IGVIITWIGMNS |
| | | TCAGAAGGAAACCCTCGTGACCT | | RSTSLSVSLVLV |
| | | TCAAGAATCCTCACGCCAAGAAG | | GVVTLYLGAMVQ |
| | | CAGGACGTGGTGGTGCTGGGTTC | | A (SEQ ID |
| | | CCAAGAAGGGGCCATGCATACTG | | NO: 164) |
| | | CCCTCACTGGAGCGACCGAAATC | | |
| | | CAGATGTCGTCCGGCAACCTCCT | | |
| | | GTTCACCGGCCACCTGAAGTGCC | | |
| | | GCCTGCGGATGGACAAGTTGCAG | | |
| | | CTGAAGGGAATGAGCTACTCGAT | | |
| | | GTGTACCGGAAAGTTCAAGATCG | | |
| | | TGAAGGAAATCGCCGAAACCCAG | | |
| | | CACGGAACCATCGTCATTAGAGT | | |
| | | GCAGTACGAAGGGGACGGCAGCC | | |
| | | CGTGCAAGATCCCCTTCGAAATT | | |
| | | ATGGACCTGGAGAAGCGCCACGT | | |
| | | GCTCGGAAGGCTCATCACTGTCA | | |
| | | ACCCAATCGTCACCGAAAAGGAC | | |
| | | TCCCCTGTGAACATCGAAGCAGA | | |
| | | GCCCCCTTTCGGGGACTCCTACA | | |
| | | TTATTATCGGCGTGGAGCCCGGC | | |
| | | CAGCTGAAGCTGAACTGGTTCAA | | |
| | | GAAGGGATCCTCGATCGGACAGA | | |
| | | TGTTCGAAACCACCATGCGGGGA | | |
| | | GCCAAGCGGATGGCTATTCTGGG | | |
| | | AGATACCGCTTGGGATTTCGGCT | | |
| | | CCCTCGGCGGCGTCTTTACTTCC | | |
| | | ATCGGGAAAGCGCTCCACCAAGT | | |
| | | GTTTGGAGCCATCTACGGTGCCG | | |
| | | CTTTTTCCGGGGTGTCATGGACC | | |
| | | ATGAAGATTCTTATCGGGGTCAT | | |
| | | TATTACTTGGATCGGCATGAACT | | |
| | | CCCGGAGCACCTCGCTGTCCGTG | | |
| | | AGCCTCGTGCTCGTGGGGGTGGT | | |
| | | CACTCTGTATCTTGGTGCCATGG | | |
| | | TGCAGGCCTAG (SEQ ID NO: | | |
| | | 146) | | |
| Dengue 2 | TCAAGCTT | ATGCTTAACATCCTGAATAGAAG | TGATAATA | **MLNILNRRRRTA** |
| prME | TTGGACCC | AAGAAGAACCGCCGGCATTATCA | GGCTGGAG | **GIIIMMIPTVMA** |
| (Thailand/ | TCGTACAG | TTATGATGATACCCACCGTGATG | CCTCGGTG | FHLTTRNGEPHM |
| NGS- | AAGCTAAT | GCCTTCCACCTGACTACTCGCAA | GCCATGCT | IVSRQEKGKSLL |
| C/1944) | ACGACTCA | CGGAGAGCCTCATATGATCGTGT | TCTTGCCC | FKTEDGVNMCTL |
| | CTATAGGG | CGCGGCAGGAGAAGGGAAAGTCC | CTTGGGCC | MAMDLGELCEDT |
| | AAATAAGA | CTGCTGTTTAAGACGGAGGACGG | TCCCCCCA | ITYKCPFLKQNE |
| | GAGAAAAG | CGTGAACATGTGCACTCTTATGG | GCCCCTCC | PEDIDCWCNSTS |
| | AAGAGTAA | CAATGGACCTTGGAGAGCTGTGC | TCCCCTTC | TWVTYGTCTTTG |

TABLE 34-continued

Example DENV2 PrME Polypeptide

| Sequence Name | 5' UTR | ORF | 3' UTR | Polypeptide Sequence |
|---|---|---|---|---|
| | GAAGAAAT | GAGGATACCATCACCTACAAGTG | CTGCACCC | EHRREKRSVALV |
| | ATAAGAGC | TCCGTTCCTGAAGCAAAACGAGC | GTACCCCC | PHVGMGLETRTE |
| | CACC | CTGAGGATATTGACTGCTGGTGC | GTGGTCTT | TWMSSEGAWKHA |
| | (SEQ ID | AACTCCACCTCAACCTGGGTCAC | TGAATAAA | QRIETWILRHPG |
| | NO: 138) | ATATGGGACCTGTACCACTACTG | GTCTGAGT | FTIMAAILAYTI |
| | | GCGAACACCGCCGCGAGAAAAGA | GGGCGGC | GTTHFQRALIFI |
| | | AGCGTGGCGTTGGTGCCTCACGT | (SEQ ID | LLTAVAPSMTMR |
| | | CGGCATGGGTCTGGAAACTCGGA | NO: 156) | CIGISNRDFVEG |
| | | CCGAAACTTGGATGAGCTCAGAG | | VSGGSWVDIVLE |
| | | GGGGCATGGAAGCACGCCCAGAG | | HGSCVTTMAKNK |
| | | GATTGAAACCTGGATTCTGCGCC | | PTLDFELIETEA |
| | | ACCCTGGATTCACCATCATGGCG | | KQPATLRKYCIE |
| | | GCTATTCTGGCGTACACTATTGG | | AKLTNTTTDSRC |
| | | AACCACCCACTTTCAGCGGGCCC | | PTQGEPSLNEEQ |
| | | TTATCTTCATCCTCCTCACTGCC | | DKRFVCKHSMVD |
| | | GTGGCGCCCTCCATGACTATGCG | | RGWGNGCGLFGK |
| | | GTGTATCGGAATTTCCAACCGCG | | GGIVTCAMFTCK |
| | | ACTTCGTGGAAGGAGTGTCCGGA | | KNMKGKVVQPEN |
| | | GGCTCCTGGGTCGACATTGTGCT | | LEYTIVITPHSG |
| | | GGAACATGGTTCATGCGTGACCA | | EEHAVGNDTGKH |
| | | CGATGGCCAAGAACAAGCCCACC | | GKEIKITPQSSI |
| | | CTCGACTTCGAGCTGATCGAGAC | | TEAELTGYGTVT |
| | | TGAAGCCAAGCAGCCGGCCACTC | | MECSPRTGLDFN |
| | | TGCGGAAGTACTGTATCGAGGCC | | EMVLLQMENKAW |
| | | AAGCTCACCAACACCACCACCGA | | LVHRQWFLDLPL |
| | | TTCCCGCTGCCCGACCCAAGGAG | | PWLPGADTQGSN |
| | | AACCTTCGCTCAACGAGGAGCAG | | WIQKETLVTFKN |
| | | GACAAGCGGTTCGTGTGCAAGCA | | PHAKKQDVVVLG |
| | | CAGCATGGTCGACAGGGGATGGG | | SQEGAMHTALTG |
| | | GGAATGGATGCGGTCTGTTCGGA | | ATEIQMSSGNLL |
| | | AAGGGAGGCATTGTGACTTGTGC | | FTGHLKCRLRMD |
| | | AATGTTCACTTGCAAGAAGAACA | | KLQLKGMSYSMC |
| | | TGAAGGGGAAGGTCGTGCAGCCG | | TGKFKVVKEIAE |
| | | GAAAACCTGGAGTACACCATCGT | | TQHGTIVIRVQY |
| | | GATCACCCCTCATTCGGGCGAAG | | EGDGSPCKIPFE |
| | | AACACGCTGTGGGGAATGATACC | | IMDLEKRHVLGR |
| | | GGAAAGCACGGAAAGGAAATTAA | | LITVNPIVTEKD |
| | | GATCACACCCCAATCCAGCATCA | | SPVNIEAEPPFG |
| | | CTGAGGCAGAACTGACCGGCTAC | | DSYIIIGVEPGQ |
| | | GGCACTGTGACCATGGAGTGCTC | | LKLNWFKKGSSI |
| | | GCCTCGGACTGGCCTGGACTTCA | | GQMIETTMRGAK |
| | | ACGAGATGGTGCTGCTCCAAATG | | RMAILGDTAWDF |
| | | GAAAACAAGGCCTGGCTGGTGCA | | GSLGGVFTSIGK |
| | | CAGACAGTGGTTCCTCGATTTGC | | ALHQVFGAIYGA |
| | | CCTTGCCGTGGCTCCCTGGCGCC | | AFSGVSWIMKIL |
| | | GACACCCAGGGATCTAACTGGAT | | IGVIITWIGMNS |
| | | CCAGAAGGAAACCCTTGTGACCT | | RSTSLSVSLVLV |
| | | TCAAGAACCCGCACGCTAAGAAA | | GVVTLYLGVMVQ |
| | | CAGGATGTGGTGGTGCTGGGAAG | | A (SEQ ID |
| | | CCAGGAAGGAGCAATGCATACCG | | NO: 165) |
| | | CGCTCACGGGTGCCACCGAGATC | | |
| | | CAGATGAGCTCCGGGAACCTCCT | | |
| | | GTTCACCGGTCACCTGAAGTGCC | | |
| | | GACTCCGCATGGACAAACTGCAG | | |
| | | CTCAAGGGGATGTCCTACTCCAT | | |
| | | GTGCACCGGGAAATTCAAGGTCG | | |
| | | TGAAGGAGATCGCTGAGACTCAG | | |
| | | CACGGTACTATCGTGATCCGGGT | | |
| | | GCAGTATGAGGGAGATGGGAGCC | | |
| | | CGTGCAAAATCCCATTTGAGATC | | |
| | | ATGGACTTGGAAAAGCGCCATGT | | |
| | | GCTGGGTCGGCTGATTACCGTGA | | |
| | | ACCCAATCGTCACCGAAAAGGAC | | |
| | | AGCCCCGTCAACATTGAAGCCGA | | |
| | | ACCACCCTTCGGAGACTCGTACA | | |
| | | TCATCATTGGCGTGGAACCGGGC | | |
| | | CAGCTGAAGCTGAACTGGTTCAA | | |
| | | AAAGGGGTCCTCTATCGGCCAAA | | |
| | | TGATCGAAACCACCATGCGGGGA | | |
| | | GCTAAGCGGATGGCGATTTTGGG | | |
| | | AGACACTGCGTGGGACTTTGGCT | | |
| | | CACTGGGGGGAGTGTTCACCAGC | | |
| | | ATCGGCAAAGCCCTGCACCAAGT | | |
| | | GTTCGGTGCCATCTACGGAGCCG | | |
| | | CCTTCAGCGGAGTGTCCTGGATC | | |

TABLE 34-continued

| Example DENV2 PrME Polypeptide | | | | |
|---|---|---|---|---|
| Sequence Name | 5' UTR | ORF | 3' UTR | Polypeptide Sequence |
| | | ATGAAGATCCTGATCGGCGTGAT<br>CATTACCTGGATCGGCATGAACT<br>CCAGGTCCACCTCGCTCTCCGTG<br>TCGCTGGTGCTGGTCGGGGTCGT<br>GACCCTGTACCTGGGAGTGATGG<br>TCCAGGCCTGA (SEQ ID NO: 147) | | |
| Dengue 2 prME (PuertoRico/ PR159- S1/1969) | TCAAGCTT<br>TTGGACCC<br>TCGTACAG<br>AAGCTAAT<br>ACGACTCA<br>CTATAGGG<br>AAATAAGA<br>GAGAAAAG<br>AAGAGTAA<br>GAAGAAAT<br>ATAAGAGC<br>CACC<br>(SEQ ID NO: 139) | ATGTTGAATATCCTGAACCGCCG<br>CCGGAGAACTGCCGGAATTATCA<br>TTATGATGATCCCTACCGTGATG<br>GCGTTCCACCTTACTACCCGGAA<br>CGGGGAGCCTCACATGATCGTGT<br>CACGCCAGGAGAAGGGGAAATCC<br>CTGCTGTTCAAGACCAAGGACGG<br>TACCAACATGTGTACCCTGATGG<br>CGATGGACCTCGGAGAGCTGTGC<br>GAGGACACCATCACCTACAAATG<br>CCCGTTCCTGAAGCAGAACGAGC<br>CGGAAGATATTGACTGTTGGTGC<br>AACTCCACCTCCACTTGGGTCAC<br>CTACGGAACTTGCACCACTACTG<br>GGGAGCATAGACGGGAGAAGCGC<br>TCCGTGGCCCTGGTGCCGCACGT<br>CGGCATGGGACTGGAAACCAGAA<br>CCGAGACTTGGATGTCCAGCGAA<br>GGCGCCTGGAAGCACGCCCAGCG<br>GATTGAAACTTGGATCCTGAGGC<br>ACCCGGGTTTTACCATTATGGCC<br>GCTATCTTGGCATACACCATCGG<br>CACCACCCACTTCCAACGCGTCC<br>TGATCTTCATCCTGCTGACCGCC<br>ATTGCGCCCTCCATGACCATGCG<br>GTGCATCGGAATCAGCAACCGCG<br>ACTTCGTGGAAGGCGTCAGCGGC<br>GGTTCTTGGGTGGACATCGTGTT<br>GGAGCACGGATCGTGCGTGACCA<br>CCATGGCCAAGAACAAGCCGACC<br>CTCGATTTCGAGCTGATCAAGAC<br>TGAAGCCAAGCAGCCAGCTACCC<br>TGCGGAAGTATTGCATCGAAGCC<br>AAGCTCACTAATACTACGACCGA<br>CAGCCGGTGTCCGACCCAAGGAG<br>AGCCCACCCTGAATGAGGAACAA<br>GACAAGCGCTTCGTGTGCAAGCA<br>TTCCATGGTGGACCGGGGCTGGG<br>GAAACGGCTGCGGACTGTTCGGG<br>AAAGGAGGAATTGTGACTTGCGC<br>CATGTTCACTTGCAAGAAGAACA<br>TGGAGGGGAAGATCGTCCAGCCT<br>GAGAACCTCGAGTACACGGTCGT<br>GATTACTCCGCACTCGGGAGAAG<br>AACACGCCGTGGGCAACGACACC<br>GGAAAGCATGGGAAGGAAGTGAA<br>AATCACGCCCCAATCGTCGATTA<br>CCGAGGCTGAGCTGACCGGCTAC<br>GGCACCGTGACCATGGAGTGCTC<br>CCCGAGGACCGGACTGGACTTCA<br>ACGAAATGGTGCTGCTGCAGATG<br>AAGGACAAGGCCTGGCTGGTGCA<br>CCGCCAGTGGTTCCTCGACCTCC<br>CACTCCCCTGGCTGCCCGGAGCG<br>GATACGCAGGGATCCAACTGGAT<br>CCAGAAGGAAACTCTTGTGACCT<br>TCAAGAACCCTCATGCCAAGAAG<br>CAGGACGTGGTGGTCCTGGGATC<br>CCAAGAGGGCGCGATGCACACCG<br>CACTGACCGGCGCCACCGAAATT<br>CAGATGTCCTCCGGAAACCTCCT<br>GTTCACTGGCCACCTGAAGTGCA<br>GACTCCGCATGGACAAGCTGCAG<br>CTCAAGGGGATGAGCTACTCCAT<br>GTGTACCGGAAAATTCAAGGTCG<br>TGAAGGAAATTGCAGAAACACAG<br>CATGGGACAATTGTCATTCGGGT | TGATAATA<br>GGCTGGAG<br>CCTCGGTG<br>GCCATGCT<br>TCTTGCCC<br>CTTGGGCC<br>TCCCCCCA<br>GCCCCTCC<br>TCCCCTTC<br>CTGCACCC<br>GTACCCCC<br>GTGGTCTT<br>TGAATAAA<br>GTCTGAGT<br>GGGCGGC<br>(SEQ ID NO: 157) | MLNILNRRRRTA<br>GIIIMMIPTVMA<br>FHLTTRNGEPHM<br>IVSRQEKGKSLL<br>FKTKDGTNMCTL<br>MAMDLGELCEDT<br>ITYKCPFLKQNE<br>PEDIDCWCNSTS<br>TWVTYGTCTTTG<br>EHRREKRSVALV<br>PHVGMGLETRTE<br>TWMSSEGAWKHA<br>QRIETWILRHPG<br>FTIMAAILAYTI<br>GTTHFQRVLIFI<br>LLTAIAPSMTMR<br>CIGISNRDFVEG<br>VSGGSWVDIVLE<br>HGSCVTTMAKNK<br>PTLDFELIKTEA<br>KQPATLRKYCIE<br>AKLTNTTTDSRC<br>PTQGEPTLNEEQ<br>DKRFVCKHSMVD<br>RGWGNGCGLFGK<br>GGIVTCAMFTCK<br>KNMEGKIVQPEN<br>LEYTVVITPHSG<br>EEHAVGNDTGKH<br>GKEVKITPQSSI<br>TEAELTGYGTVT<br>MECSPRTGLDFN<br>EMVLLQMKDKAW<br>LVHRQWFLDLPL<br>PWLPGADTQGSN<br>WIQKETLVTFKN<br>PHAKKQDVVVLG<br>SQEGAMHTALTG<br>ATEIQMSSGNLL<br>FTGHLKCRLRMD<br>KLQLKGMSYSMC<br>TGKFKVVKEIAE<br>TQHGTIVIRVQY<br>EGDGSPCKTPFE<br>IMDLEKRHVLGR<br>LTTVNPIVTEKD<br>SPVNIEAEPPFG<br>DSYIIIGVEPGQ<br>LKLDWFKKGSSI<br>GQMFETTMRGAK<br>RMAILGDTAWDF<br>GSLGGVFTSIGK<br>ALHQVFGAIYGA<br>AFSGVSWTMKIL<br>IGVIITWIGMNS<br>RSTSLSVSLVLV<br>GIVTLYLGVMVQ<br>A (SEQ ID NO: 166) |

TABLE 34-continued

| Example DENV2 PrME Polypeptide | | | | |
|---|---|---|---|---|
| Sequence Name | 5' UTR | ORF | 3' UTR | Polypeptide Sequence |
| | | CCAGTACGAGGGCGATGGTTCAC<br>CGTGCAAGACTCCATTCGAGATC<br>ATGGATCTGGAGAAAAGACACGT<br>GCTGGGTCGGCTGACTACCGTGA<br>ACCCAATCGTGACTGAGAAGGAC<br>TCCCCCGTGAACATCGAAGCCGA<br>GCCTCCTTTTGGCGATTCCTACA<br>TCATCATTGGAGTGGAACCCGGA<br>CAGCTTAAGTTGGATTGGTTCAA<br>GAAGGGCTCCTCGATCGGACAGA<br>TGTTCGAAACCACCATGCGCGGT<br>GCCAAGCGAATGGCCATCCTGGG<br>GGACACCGCCTGGGACTTCGGTA<br>GCCTGGGCGGAGTGTTTACCTCA<br>ATTGGAAAGGCTCTGCACCAAGT<br>GTTTGGGGCGATCTACGGAGCGG<br>CCTTCAGCGGTGTCTCCTGGACT<br>ATGAAGATTCTCATCGGAGTGAT<br>AATCACCTGGATCGGCATGAACA<br>GCCGGTCAACCAGCCTGTCCGTG<br>TCCCTGGTGCTGGTCGGCATCGT<br>GACTCTCTACCTCGGAGTGATGG<br>TGCAGGCCTAG (SEQ ID NO:<br>148) | | |
| Dengue 2<br>prME<br>(16681-<br>PDK53) | TCAAGCTT<br>TTGGACCC<br>TCGTACAG<br>AAGCTAAT<br>ACGACTCA<br>CTATAGGG<br>AAATAAGA<br>GAGAAAAG<br>AAGAGTAA<br>GAAGAAAT<br>ATAAGAGC<br>CACC<br>(SEQ ID<br>NO: 140) | ATGCTCAACATACTGAACAGACG<br>GAGAAGGACCGCCGGTATTATTA<br>TCATGATGATCCCTACTGTGATG<br>GCATTCCACCTGACAACCCGCAA<br>CGGAGAGCCCCACATGATCGTGT<br>CACGCCAGGAGAAAGGGAAGTCA<br>CTGCTGTTCAAGACCGAAGTCGG<br>CGTGAACATGTGTACCCTGATGG<br>CGATGGATCTTGGCGAACTGTGC<br>GAGGACACCATCACGTACAAGTG<br>CCCCCTGTTGCGGCAAAACGAAC<br>CAGAGGACATCGACTGCTGGTGT<br>AACTCCACCTCGACCTGGGTCAC<br>CTACGGAACCTGTACCACTATGG<br>GGGAACACCGGCGGGAGAAGCGC<br>TCCGTGGCGCTCGTGCCTCATGT<br>CGGCATGGGACTGGAGACTCGGA<br>CTGAAACCTGGATGTCGTCGGAG<br>GGGGCCTGGAAGCACGTCCAGCG<br>GATCGAGACTTGGATCCTTCGCC<br>ATCCGGGCTTCACCATGATGGCC<br>GCCATCCTGGCCTACACCATCGG<br>AACCACCCATTTCCAACGGGCCC<br>TGATCCTGATCCTGTTGACTGCC<br>GTGACCCCCTCCATGACTATGCG<br>GTGCATTGGGATGTCGAACAGGG<br>ATTTCGTGGAGGGAGTCAGCGGT<br>GGCAGCTGGGTGGACATCGTGCT<br>GGAACATGGATCCTGCGTGACTA<br>CCATGGCAAAGAACAAGCCAACC<br>CTCGATTTCGAACTGATCAAGAC<br>CGAGGCGAAACAGCCGGCGACCC<br>TGAGGAAGTACTGCATCGAGGCC<br>AAGCTCACCAACACCACTACCGA<br>GAGCAGATGCCCTACCCAAGGGG<br>AACCTTCCCTGAACGAGGAGCAG<br>GACAAGAGATTCGTCTGCAAGCA<br>CTCCATGGTGGACCGCGGCTGGG<br>GAAACGGATGCGGACTCTTCGGA<br>AAGGGCGGTATTGTGACCTGTGC<br>CATGTTCCGCTGCAAGAAAAACA<br>TGGAAGGGAAAGTGGTGCAGCCC<br>GAGAACCTCGAGTACACTATCGT<br>GATCACACCGCACAGCGGAGAAG<br>AACACGCCGTGGGCAACGACACT<br>GGAAAGCACGGGAAGGAAATCAA<br>GATCACCCCGCAATCCTCAATCA<br>CTGAGGCTGAGTTGACCGGCTAC<br>GGGACTATTACCATGGAATGCTC<br>CCCACGAACGGGACTGGACTTCA | TGATAATA<br>GGCTGGAG<br>CCTCGGTG<br>GCCATGCT<br>TCTTGCCC<br>CTTGGGCC<br>TCCCCCCA<br>GCCCCTCC<br>TCCCCTTC<br>CTGCACCC<br>GTACCCCC<br>GTGGTCTT<br>TGAATAAA<br>GTCTGAGT<br>GGGCGGC<br>(SEQ ID<br>NO: 158) | **MLNILNRRRRTA**<br>**GIIIMMIPTVMA**<br>FHLTTRNGEPHM<br>IVSRQEKGKSLL<br>FKTEVGVNMCTL<br>MAMDLGELCEDT<br>ITYKCPLLRQNE<br>PEDIDCWCNSTS<br>TWVTYGTCTTMG<br>EHRREKRSVALV<br>PHVGMGLETRTE<br>TWMSSEGAWKHV<br>QRIETWILRHPG<br>FTMMAAILAYTI<br>GTTHFQRALILI<br>LLTAVTPSMTMR<br>CIGMSNRDFVEG<br>VSGGSWVDIVLE<br>HGSCVTTMAKNK<br>PTLDFELIKTEA<br>KQPATLRKYCIE<br>AKLTNTTTESRC<br>PTQGEPSLNEEQ<br>DKRFVCKHSMVD<br>RGWGNGCGLFGK<br>GGIVTCAMFRCK<br>KNMEGKVVQPEN<br>LEYTIVITPHSG<br>EEHAVGNDTGKH<br>GKEIKITPQSSI<br>TEAELTGYGTIT<br>MECSPRTGLDFN<br>EIVLLQMENKAW<br>LVHRQWFLDLPL<br>PWLPGADTQGSN<br>WIQKETLVTFKN<br>PHAKKQDVVVLG<br>SQEGAMHTALTG<br>ATEIQMSSGNLL<br>FTGHLKCRLRMD<br>KLQLKGMSYSMC<br>TGKFKVVKEIAE<br>TQHGTIVIRVQY<br>EGDGSPCKIPFE<br>IMDLEKRHVLGR<br>LITVNPIVTEKD<br>SPVNIEAEPPFG<br>DSYIIIGVEPGQ<br>LKLNWFKKGSSI<br>GQMFETTMRGAK |

TABLE 34-continued

Example DENV2 PrME Polypeptide

| Sequence Name | 5' UTR | ORF | 3' UTR | Polypeptide Sequence |
|---|---|---|---|---|
| | | ACGAAATTGTGTTGCTCCAAATG | | RMAILGDTAWDF |
| | | GAAAACAAGGCCTGGCTCGTGCA | | GSLGGVFTSIGK |
| | | CCGGCAGTGGTTCCTGGATCTGC | | ALHQVFGAIYGA |
| | | CCCTGCCGTGGCTGCCGGGTGCC | | AFSGVSWTMKIL |
| | | GACACTCAGGGGAGCAACTGGAT | | IGVIITWIGMNS |
| | | TCAGAAGGAAACCCTTGTGACCT | | RSTSLSVTLVLV |
| | | TCAAGAACCCCCACGCAAAGAAG | | GIVTLYLGVMVQ |
| | | CAGGACGTGGTGGTGCTGGGTAG | | A (SEQ ID |
| | | CCAAGAAGGCGCCATGCACACGG | | NO: 167) |
| | | CCCTGACCGGAGCGACCGAGATC | | |
| | | CAGATGTCCAGCGGAAATCTGCT | | |
| | | CTTTACTGGTCATCTGAAGTGCA | | |
| | | GACTTCGGATGGACAAGCTGCAA | | |
| | | CTGAAGGGAATGTCCTACTCAAT | | |
| | | GTGCACTGGAAAGTTCAAGGTCG | | |
| | | TGAAGGAGATCGCCGAAACCCAG | | |
| | | CACGGGACTATCGTCATCCGCGT | | |
| | | GCAGTACGAAGGAGATGGCTCCC | | |
| | | CGTGCAAGATCCCTTTCGAAATC | | |
| | | ATGGACCTGGAGAAGCGCCACGT | | |
| | | GTTGGGGCGCCTTATTACTGTGA | | |
| | | ACCCCATCGTGACCGAGAAGGAC | | |
| | | TCCCCTGTCAACATCGAGGCTGA | | |
| | | ACCGCCATTCGGAGATTCCTATA | | |
| | | TCATTATCGGAGTGGAACCGGGC | | |
| | | CAGCTCAAGCTGAATTGGTTCAA | | |
| | | GAAGGGATCCTCGATTGGCCAGA | | |
| | | TGTTCGAAACGACTATGCGGGGC | | |
| | | GCTAAGCGCATGGCCATCCTGGG | | |
| | | CGATACTGCCTGGGATTTTGGTT | | |
| | | CTCTGGGCGGAGTGTTCACCTCC | | |
| | | ATTGGAAAGGCCCTGCACCAAGT | | |
| | | GTTCGGCGCCATCTACGGTGCCG | | |
| | | CGTTTAGCGGTGTCTCATGGACC | | |
| | | ATGAAAATCCTCATTGGCGTGAT | | |
| | | CATTACCTGGATTGGCATGAACT | | |
| | | CCAGAAGCACTTCCCTGTCCGTG | | |
| | | ACCCTGGTGCTCGTCGGAATTGT | | |
| | | GACACTCTACCTCGGAGTGATGG | | |
| | | TGCAGGCTTGA (SEQ ID NO: | | |
| | | 149) | | |
| Dengue 2 | TCAAGCTT | ATGCTGAACATTTTGAACAGACG | TCAAGCTT | **MLNILNRRRRTA** |
| prME | TTGGACCC | CCGAAGGACCGCAGGCATTATCA | TTGGACCC | **GIIIMMIPTVMA** |
| (Peru/IQT2 | TCGTACAG | TTATGATGATCCCTACCGTGATG | TCGTACAG | FHLTTRNGEPHM |
| 913/1996) | AAGCTAAT | GCCTTCCATCTGACTACTAGGAA | AAGCTAAT | IVSRQEKGKSLL |
| | ACGACTCA | CGGAGAGCCACATATGATCGTGT | ACGACTCA | FKTKDGTNMCTL |
| | CTATAGGG | CGCGCCAGGAAAAGGGAAAGAGC | CTATAGGG | MAMDLGELCEDT |
| | AAATAAGA | CTGCTTTTTAAAACCAAGGACGG | AAATAAGA | ITYKCPFLKQNE |
| | GAGAAAAG | CACGAACATGTGCACCCTTATGG | GAGAAAAG | PEDIDCWCNSTS |
| | AAGAGTAA | CCATGGACCTGGGGGAGTTGTGC | AAGAGTAA | TWVTYGTCTTTG |
| | GAAGAAAT | GAGGACACCATCACCTACAAGTG | GAAGAAAT | EHRREKRSVALV |
| | ATAAGAGC | CCCGTTCCTGAAGCAAAACGAGC | ATAAGAGC | PHVGMGLETRTE |
| | CACC | CCGAAGATATTGACTGCTGGTGC | CACC | TWMSSEGAWKHA |
| | (SEQ ID | AACTCCACCTCCACCTGGGTCAC | (SEQ ID | QRIETWILRHPG |
| | NO: 141) | TTATGGGACTTGCACCACCACCG | NO: 159) | FTIMAAILAYTI |
| | | GCGAACATCGCAGAGAAAAGAGA | | GTTHFQRVLIFI |
| | | AGCGTGGCCCTGGTCCCCCACGT | | LLTAIAPSMTMR |
| | | CGGGATGGGCCTCGAGACTCGGA | | CIGISNRDFVEG |
| | | CCGAAACTTGGATGTCATCAGAG | | VSGGSWVDIVLE |
| | | GGCGCATGGAAGCATGCTCAGCG | | HGSCVTTMAKNK |
| | | GATCGAAACCTGGATCCTGAGAC | | PTLDFELIKTEA |
| | | ACCCTGGTTTCACAATTATGGCC | | KQPATLRKYCIE |
| | | GCCATTCTTGCGTACACGATCGG | | AKLTNTTTDSRC |
| | | AACGACTCATTTCCAACGCGTGC | | PTQGEPTLNEEQ |
| | | TGATCTTCATTCTCCTGACCGCT | | DKRFVCKHSMVD |
| | | ATTGCGCCGTCCATGACTATGCG | | RGWGNGCGLFGK |
| | | GTGCATCGGAATCTCAAACCGGG | | GGIVTCAMFTCK |
| | | ACTTCGTGGAAGGAGTGTCGGGA | | KNMEGKIVQPEN |
| | | GGATCCTGGGTGGACATTGTGCT | | LEYTVVITPHSG |
| | | GGAGCACGGTTCCTGCGTCACCA | | EEHAVGNDTGKH |
| | | CCATGGCCAAAAACAAGCCTACC | | GKEVKITPQSSI |
| | | CTGGACTTCGAGCTGATCAAGAC | | TEAELTGYGTVT |
| | | TGAGGCCAAGCAGCCCGCGACCC | | MECSPRTGLDFN |
| | | TCCGGAAGTACTGCATCGAGGCC | | EMVLLQMEDKAW |

TABLE 34-continued

Example DENV2 PrME Polypeptide

| Sequence Name | 5' UTR | ORF | 3' UTR | Polypeptide Sequence |
|---|---|---|---|---|
| | | AAGTTGACCAACACTACTACCGA | | LVHRQWFLDLPL |
| | | TTCCCGGTGCCCGACCCAAGGAG | | PWLPGADTQGSN |
| | | AACCAACTCTGAACGAAGAACAG | | WIQKETLVTFKN |
| | | GATAAGCGGTTTGTGTGCAAGCA | | PHAKKQDVVVLG |
| | | CTCAATGGTGGACAGGGGATGGG | | SQEGAMHTALTG |
| | | GCAACGGCTGTGGACTGTTCGGA | | ATEIQMSSGNLL |
| | | AAGGGTGGTATTGTGACCTGTGC | | FTGHLKCRLRMD |
| | | AATGTTTACCTGTAAAAAGAATA | | KLQLKGMSYSMC |
| | | TGGAGGGGAAGATCGTGCAGCCT | | TGKFKIVKEIAE |
| | | GAAAATCTCGAGTACACTGTCGT | | TQHGTIVIRVQY |
| | | CATCACCCCGCACTCGGGAGAGG | | EGDGSPCKIPFE |
| | | AGCACGCTGTGGGCAACGACACC | | IMDLEKRHVLGR |
| | | GGAAAGCACGGAAAGGAGGTCAA | | LITVNPIVTEKD |
| | | GATAACCCCGCAATCCTCCATTA | | SPVNIEAEPPFG |
| | | CGGAAGCCGAACTGACTGGTTAC | | DSYIIIG**A**EPGQ |
| | | GGCACCGTGACTATGGAGTGCTC | | LKLDWFKKGSSI |
| | | CCCTCGGACCGGCCTGGACTTCA | | GQMFETTMRGAK |
| | | ACGAAATGGTGCTGCTCCAAATG | | RMAILGDTAWDF |
| | | GAAGATAAGGCCTGGCTGGTGCA | | GSLGGVFTSIGK |
| | | CAGGCAGTGGTTCCTGGATCTCC | | ALHQVFGAIYGA |
| | | CGCTGCCGTGGCTGCCTGGCGCT | | AFSGVSWTMKIL |
| | | GACACTCAGGGAAGCAACTGGAT | | IGVIITWIGMNS |
| | | CCAGAAGGAAACCCTCGTGACCT | | RSTSLSVSLVLV |
| | | TTAAGAACCCCCACGCCAAGAAG | | GIVTLYLGVMVQ |
| | | CAGGATGTGGTGGTGTTGGGAAG | | A (SEQ ID |
| | | CCAGGAGGGGGCCATGCATACTG | | NO: 168) |
| | | CCCTCACCGGCGCGACCGAAATC | | |
| | | CAGATGTCGTCCGGCAATCTGCT | | |
| | | GTTCACCGGACACCTCAAGTGTC | | |
| | | GCCTTCGGATGGACAAGCTGCAG | | |
| | | CTGAAGGGAATGAGCTACAGCAT | | |
| | | GTGCACCGGGAAGTTCAAGATCG | | |
| | | TGAAGGAAATCGCCGAAACCCAG | | |
| | | CACGGAACCATCGTGATCCGGGT | | |
| | | GCAGTACGAGGGCGACGGTTCTC | | |
| | | CCTGCAAAATCCCCTTCGAAATC | | |
| | | ATGGATCTGGAGAAGAGACACGT | | |
| | | CCTGGGTCGCCTGATCACCGTGA | | |
| | | ACCCCATTGTGACTGAGAAGGAC | | |
| | | TCCCCAGTGAACATCGAAGCGGA | | |
| | | GCCCCCATTCGGAGACAGCTACA | | |
| | | TTATCATTGGTGCCGAACCGGGG | | |
| | | CAGCTGAAACTGGACTGGTTCAA | | |
| | | GAAGGGCAGCTCGATTGGCCAAA | | |
| | | TGTTCGAAACGACAATGCGGGGC | | |
| | | GCAAAGCGCATGGCCATCCTGGG | | |
| | | AGACACTGCCTGGGACTTCGGGT | | |
| | | CCCTTGGGGGGGTGTTCACCTCG | | |
| | | ATCGGAAAAGCCTTGCACCAAGT | | |
| | | GTTCGGCGCAATCTACGGCGCCG | | |
| | | CGTTCTCGGGAGTCTCCTGGACT | | |
| | | ATGAAGATCCTGATCGGTGTCAT | | |
| | | CATCACCTGGATCGGGATGAACT | | |
| | | CCCGGTCCACTTCCCTCTCGGTG | | |
| | | TCACTCGTGCTTGTGGGAATTGT | | |
| | | CACCCTGTACCTCGGAGTGATGG | | |
| | | TGCAGGCCTGA (SEQ ID NO: | | |
| | | 150) | | |
| Dengue 2 | TCAAGCTT | ATGCTGAATATTCTGAACCGACG | TGATAATA | **MLNILNRRRRTA** |
| prME | TTGGACCC | CCGCCGCACTGCCGGAATCATTA | GGCTGGAG | **GIIIMMIPTVMA** |
| (Thailand/ | TCGTACAG | TCATGATGATCCCTACCGTGATG | CCTCGGTG | FHLTTRNGEPHM |
| PUO- | AAGCTAAT | GCGTTCCATCTCACCACTCGGAA | GCCATGCT | IVSRQEKGKSLL |
| 218/1980) | ACGACTCA | TGGCGAACCCCATATGATCGTGT | TCTTGCCC | FKTEDGVNMCTL |
| | CTATAGGG | CGAGACAGGAAAAGGGAAAGAGC | CTTGGGCC | MAMDLGELCEDT |
| | AAATAAGA | CTTTTGTTCAAAACTGAAGATGG | TCCCCCCA | ITYKCPLLRQNE |
| | GAGAAAAG | AGTGAACATGTGCACTCTCATGG | GCCCCTCC | PEDIDCWCNSTS |
| | AAGAGTAA | CAATGGATCTGGGCGAACTGTGC | TCCCCTTC | TWVTYGTCTTTG |
| | GAAGAAAT | GAAGATACCATCACTTACAAGTG | CTGCACCC | EHRREKRSVALV |
| | ATAAGAGC | TCCGCTGTTGAGACAGAACGAGC | GTACCCCC | PHVGMGLETRTE |
| | CACC | CTGAGGACATCGACTGCTGGTGT | GTGGTCTT | TWMSSEGAWKHA |

TABLE 34-continued

Example DENV2 PrME Polypeptide

| Sequence Name | 5' UTR | ORF | 3' UTR | Polypeptide Sequence |
|---|---|---|---|---|
| | (SEQ ID | AACAGCACTTCCACCTGGGTCAC | TGAATAAA | QRIEIWILRHPG |
| | NO: 142) | CTACGGCACTTGCACTACCACCG | GTCTGAGT | FTIMAAILAYTI |
| | | GAGAACACCGGCGCGAGAAGAGG | GGGCGGC | GTTHFQRALIFI |
| | | AGCGTGGCTCTTGTGCCGCACGT | (SEQ ID | LLTAVAPSMTMR |
| | | CGGCATGGGACTCGAGACTCGGA | NO: 160) | CIGISNRDFVEG |
| | | CCGAAACCTGGATGTCATCCGAA | | VSGGSWVDIVLE |
| | | GGAGCCTGGAAACACGCCCAACG | | HGSCVTTMAKNK |
| | | GATCGAAATTTGGATCCTGAGAC | | PTLDFELIKTEA |
| | | ACCCCGGTTTCACTATCATGGCC | | KQPATLRKYCIE |
| | | GCAATCCTGGCGTACACTATTGG | | AKLTNTTTESRC |
| | | CACCACGCACTTCCAGAGGGCCC | | PTQGEPSLNEEQ |
| | | TCATTTTCATCCTCCTGACTGCC | | DKRFVCKHSMVD |
| | | GTGGCGCCATCCATGACCATGAG | | RGWGNGCGLFGK |
| | | ATGTATTGGCATTTCCAACCGCG | | GGIVTCAMFTCK |
| | | ATTTCGTGGAGGGAGTGTCCGGA | | KNMEGKVVQPEN |
| | | GGATCCTGGGTCGACATCGTGCT | | LEYTIVVTPHSG |
| | | GGAACACGGATCTTGCGTCACCA | | EEHAVGNDTGKH |
| | | CCATGGCTAAGAACAAGCCCACC | | GKEIKVTPQSSI |
| | | CTCGACTTCGAGCTGATCAAGAC | | TEAELTGYGTVT |
| | | AGAAGCCAAGCAGCCGGCCACCC | | MECSPRTGLDFN |
| | | TCCGCAAGTATTGCATTGAAGCC | | EMVLLQMENKAW |
| | | AAGCTTACCAACACCACCACCGA | | LVHRQWFLDLPL |
| | | GTCGCGGTGCCCAACCCAAGGAG | | PWLPGADTQGSN |
| | | AGCCGAGCCTCAATGAGGAACAG | | WIQKETLVTFKN |
| | | GACAAGCGCTTCGTGTGCAAACA | | PHAKKQDVVVLG |
| | | CAGCATGGTCGACCGGGGTTGGG | | SQEGAMHTALTG |
| | | GCAACGGATGTGGCCTGTTCGGG | | ATEIQMSSGNLL |
| | | AAGGGTGGCATTGTGACTTGCGC | | FTGHLKCRLRMD |
| | | AATGTTCACTTGCAAGAAGAACA | | KLQLKGMSYSMC |
| | | TGGAGGGGAAAGTGGTGCAACCC | | TGKFKVVKEIAE |
| | | GAGAACCTGGAGTACACCATCGT | | TQHGTIVIRVQY |
| | | CGTGACCCCACACTCCGGAGAGG | | EGDGSPCKIPFE |
| | | AGCACGCCGTGGGAAACGACACG | | IMDLEKRHVLGR |
| | | GGGAAGCATGGAAAGGAGATCAA | | LITVNPIVTEKD |
| | | GGTCACACCCCAATCATCTATTA | | SPVNIEAEPPFG |
| | | CCGAGGCCGAACTGACCGGATAC | | DSYIIIGVEPGQ |
| | | GGTACTGTGACGATGGAGTGCAG | | LKLNWFKKGSSI |
| | | CCCGAGGACTGGACTGGACTTCA | | GQMFETTMRGAK |
| | | ACGAAATGGTGCTGCTGCAAATG | | RMAILGDTAWDF |
| | | GAGAACAAGGCCTGGCTCGTGCA | | GSLGGVFTSIGK |
| | | CCGGCAGTGGTTTCTGGATCTCC | | ALHQVFGAIYGA |
| | | CACTGCCGTGGTTGCCGGGAGCC | | AFSGVSWTMKIL |
| | | GACACCCAGGGGTCGAACTGGAT | | IGVIITWIGMNS |
| | | CCAGAAGGAAACTCTTGTGACGT | | RSTSLSVSLVLV |
| | | TTAAGAATCCTCACGCGAAGAAG | | GIVTLYLGVMVQ |
| | | CAGGACGTGGTGGTCCTGGGATC | | A (SEQ ID |
| | | GCAGGAAGGAGCTATGCACACCG | | NO: 169) |
| | | CTCTGACCGGCGCCACTGAGATC | | |
| | | CAGATGTCCTCGGGCAACCTCCT | | |
| | | GTTCACCGGTCATCTGAAGTGCC | | |
| | | GGCTGCGGATGGACAAATTGCAG | | |
| | | CTGAAGGGGATGTCCTACTCCAT | | |
| | | GTGCACCGGGAAGTTCAAGGTCG | | |
| | | TGAAGGAGATCGCGGAAACTCAG | | |
| | | CACGGCACCATTGTCATTAGAGT | | |
| | | GCAGTACGAGGGAGATGGTTCAC | | |
| | | CGTGCAAGATACCGTTCGAAATC | | |
| | | ATGGACCTGGAAAAGAGACATGT | | |
| | | CTTGGGACGCCTGATCACTGTGA | | |
| | | ACCCTATCGTGACCGAAAAGGAC | | |
| | | TCCCCTGTGAACATCGAGGCGGA | | |
| | | GCCGCCTTTCGGCGACTCCTACA | | |
| | | TCATTATCGGAGTGGAGCCCGGG | | |
| | | CAGCTGAAGCTCAACTGGTTTAA | | |
| | | GAAGGGGTCCAGCATCGGCCAGA | | |
| | | TGTTCGAAACCACCATGCGGGGG | | |
| | | GCGAAGAGGATGGCGATCCTGGG | | |
| | | AGACACCGCCTGGGATTTCGGTT | | |
| | | CACTGGGCGGAGTGTTCACCTCC | | |
| | | ATCGGAAAGGCCCTGCACCAAGT | | |
| | | GTTCGGCGCAATCTACGGTGCTG | | |
| | | CCTTCTCGGGAGTCTCCTGGACC | | |
| | | ATGAAGATCCTGATCGGCGTGAT | | |
| | | TATCACATGGATCGGCATGAACA | | |
| | | GCCGGTCAACCTCCCTTTCCGTG | | |

TABLE 34-continued

Example DENV2 PrME Polypeptide

| Sequence Name | 5' UTR | ORF | 3' UTR | Polypeptide Sequence |
|---|---|---|---|---|
| | | TCCCTGGTGCTGGTCGGCATCGT | | |
| | | GACTCTGTACCTGGGCGTGATGG | | |
| | | TGCAGGCCTGA (SEQ ID NO: | | |
| | | 151) | | |
| Dengue 2 | TCAAGCTT | ATGCTGAACATTCTGAACCGGAG | TGATAATA | **MLNILNRRRRTA** |
| prME | TTGGACCC | AAGAAGAACCGCCGGCATTATTA | GGCTGGAG | **GIIIMMIPTVMA** |
| (D2Y98P) | TCGTACAG | TCATGATGATTCCCACTGTGATG | CCTCGGTG | FHLTTRNGEPHM |
| with | AAGCTAAT | GCATTTCACCTGACCACCCGGAA | GCCATGCT | IVSRQEKGKSLL |
| native | ACGACTCA | CGGAGAACCTCATATGATCGTGT | TCTTGCCC | FKTENGVNMCTL |
| leader | CTATAGGG | CGAGACAGGAGAAGGGAAAGTCC | CTTGGGCC | MAMDLGELCEDT |
| | AAATAAGA | CTGCTGTTCAAGACAGAAAACGG | TCCCCCCA | ITYNCPLLRQNE |
| | GAGAAAAG | AGTGAACATGTGCACCCTGATGG | GCCCCTCC | PEDIDCWCNSTS |
| | AAGAGTAA | CCATGGATCTCGGCGAACTGTGC | TCCCCTTC | TWVTYGTCTATG |
| | GAAGAAAT | GAGGATACTATCACCTACAACTG | CTGCACCC | EHRREKRSVALV |
| | ATAAGAGC | TCCGTTGCTGCGCCAAAACGAGC | GTACCCCC | PHVGMGLETRTE |
| | CACC | CGGAGGACATCGACTGCTGGTGT | GTGGTCTT | TWMSSEGAWKHA |
| | (SEQ ID | AACTCCACGTCGACCTGGGTCAC | TGAATAAA | QRIETWVLRHPG |
| | NO: 143) | CTACGGCACTTGCACCGCGACCG | GTCTGAGT | FTIMAAILAYTI |
| | | GCGAACACAGAAGAGAGAAACGC | GGGCGGC | GTTYFQRVLIFI |
| | | TCCGTCGCTCTGGTGCCGCACGT | (SEQ ID | LLTAVAPSMTMR |
| | | CGGGATGGGGCTTGAAACCCGGA | NO: 161) | CIGISNRDFVEG |
| | | CTGAAACCTGGATGAGCTCGGAG | | VSGGSWVDIVLE |
| | | GGCGCTTGGAAGCATGCCCAGCG | | HGSCVTTMAKNK |
| | | CATCGAAACTTGGGTGCTGAGGC | | PTLDFELIKTEA |
| | | ATCCAGGCTTCACAATCATGGCC | | KHPATLRKYCIE |
| | | GCCATCCTCGCGTACACCATCGG | | AKLTNTTTASRC |
| | | TACTACGTACTTCCAGCGGGTGT | | PTQGEPSLNEEQ |
| | | TGATCTTCATTCTGCTGACCGCC | | DKRFVCKHSMVD |
| | | GTGGCCCCTAGCATGACCATGCG | | RGWGNGCGLFGK |
| | | GTGCATCGGGATCTCCAACCGCG | | GGIVTCAMFTCK |
| | | ATTTCGTGGAGGGGGTGTCCGGT | | KNMEGKIVQPEN |
| | | GGAAGCTGGGTGGACATTGTGCT | | LEYTIVITPHSG |
| | | GGAGCACGGCTCGTGCGTGACCA | | EENAVGNDTGKH |
| | | CCATGGCCAAGAACAAGCCCACC | | GKEIKVTPQSSI |
| | | CTTGATTTTGAGCTGATCAAGAC | | TEAELTGYGTVT |
| | | CGAAGCGAAACACCCCGCGACCC | | MECSPRTGLDFN |
| | | TCCGGAAGTACTGCATTGAAGCC | | EMVLLQMENKAW |
| | | AAGCTCACCAACACTACCACGGC | | LVHRQWFLDLPL |
| | | CTCCCGGTGCCCTACCCAAGGAG | | PWLPGADTQGSN |
| | | AACCTTCCTTGAACGAAGAACAG | | WIQKETLVTFKN |
| | | GACAAGCGCTTCGTGTGCAAGCA | | PHAKKQDVVVLG |
| | | TTCAATGGTGGACCGGGGCTGGG | | SQEGAMHTALTG |
| | | GAAATGGCTGTGGCCTCTTCGGA | | ATEIQMSSGNLL |
| | | AAAGGCGGAATTGTGACTTGCGC | | FTGHLKCRLRMD |
| | | AATGTTCACTTGCAAGAAGAACA | | KLQLKGMSYSMC |
| | | TGGAGGGAAAGATTGTGCAGCCC | | TGKFKVVKEIAE |
| | | GAGAACCTCGAGTACACTATTGT | | TQHGTIVIRVQY |
| | | CATCACTCCCCACTCCGGCGAAG | | EGDGSPCKIPFE |
| | | AAAACGCTGTCGGCAACGACACC | | IMDLEKRHVLGR |
| | | GGAAAGCATGGAAAGGAGATCAA | | LITVNPIVTEKD |
| | | GGTCACCCCGCAATCCTCAATTA | | SPVNIEAEPPFG |
| | | CTGAGGCAGAACTGACCGGTTAC | | DSYIIIGVEPGQ |
| | | GGAACTGTGACTATGGAGTGTTC | | LKLSWFKKGSSI |
| | | CCCTCGCACCGGCCTCGATTTCA | | GQMFETTMRGAK |
| | | ACGAGATGGTGCTGCTGCAAATG | | RMAILGDTAWDF |
| | | GAGAACAAGGCCTGGCTGGTGCA | | GSLGGVFTSIGK |
| | | CCGGCAGTGGTTCCTCGATTTGC | | ALHQVFGAIYGA |
| | | CCCTGCCGTGGCTGCCGGGAGCC | | AFSGVSWTMKIL |
| | | GACACTCAGGGATCCAACTGGAT | | IGVVITWIGMNS |
| | | CCAGAAAGAAACCCTCGTGACCT | | RSTSLSVSLVLV |
| | | TCAAAAACCCCCACGCGAAGAAG | | GVVTLYLGVMVQ |
| | | CAGGACGTGGTGGTGCTGGGTTC | | A (SEQ ID |
| | | CCAAGAAGGGGCGATGCATACCG | | NO: 170) |
| | | CCCTGACTGGTGCTACCGAAATC | | |
| | | CAGATGTCAAGCGGAAATCTCCT | | |
| | | GTTTACCGGTCACCTGAAGTGCA | | |
| | | GGCTCCGGATGGACAAGTTGCAG | | |
| | | CTGAAGGGGATGTCGTACAGCAT | | |
| | | GTGTACTGGGAAGTTCAAGGTCG | | |
| | | TGAAGGAGATTGCCGAAACCCAG | | |
| | | CACGGAACCATAGTCATCAGGGT | | |
| | | CCAGTACGAGGGCGACGGCAGCC | | |
| | | CTTGCAAGATCCCGTTCGAGATC | | |
| | | ATGGATCTGGAGAAGCGACACGT | | |

TABLE 34-continued

| Example DENV2 PrME Polypeptide | | | | |
|---|---|---|---|---|
| Sequence Name | 5' UTR | ORF | 3' UTR | Polypeptide Sequence |
| | | GCTGGGCCGGCTTATCACTGTGA ATCCAATCGTGACCGAGAAAGAC TCGCCCGTGAACATCGAAGCCGA GCCGCCGTTCGGCGACTCATACA TCATCATCGGCGTGGAACCAGGA CAGCTGAAGCTGTCATGGTTCAA GAAGGGTTCCAGCATTGGTCAGA TGTTCGAAACAACGATGCGCGGA GCCAAGCGCATGGCTATCCTTGG GGACACCGCCTGGGACTTCGGGT CGCTGGGAGGAGTGTTTACCAGC ATCGGAAAGGCCCTGCACCAAGT GTTCGGTGCCATCTACGGAGCCG CATTTTCCGGAGTGTCGTGGACT ATGAAGATTCTGATCGGCGTCGT GATTACCTGGATCGGGATGAACT CCAGGTCTACTTCCCTCTCCGTG AGCCTGGTGCTGGTCGGCGTGGT CACCCTGTATCTGGGCGTGATGG TCCAGGCTTAG (SEQ ID NO: 152) | | |

TABLE 35

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| AGN94866 | 3392 | 1 | Brazil | UTR5CMENS1NS2ANS2BNS3NS4A2KNS4BNS5UTR3 | 2010 | Dengue virus 1 isolate 12898/BR-PE/10, complete genome |
| AGN94867 | 3392 | 1 | Brazil | UTR5CMENS1NS2ANS2BNS3NS4A2KNS4BNS5UTR3 | 2010 | Dengue virus 1 isolate 13501/BR-PE/10, complete genome |
| AGN94868 | 3392 | 1 | Brazil | UTR5CMENS1NS2ANS2BNS3NS4A2KNS4BNS5UTR3 | 2010 | Dengue virus 1 isolate 13671/BR-PE/10, complete genome |
| AGN94869 | 3392 | 1 | Brazil | UTR5CMENS1NS2ANS2BNS3NS4A2KNS4BNS5UTR3 | 2010 | Dengue virus 1 isolate 13861/BR-PE/10, complete genome |
| AGN94870 | 3392 | 1 | Brazil | UTR5CMENS1NS2ANS2BNS3NS4A2KNS4BNS5UTR3 | 2010 | Dengue virus 1 isolate 14985/BR-PE/10, complete genome |
| AGN94871 | 3392 | 1 | Brazil | UTR5CMENS1NS2ANS2BNS3NS4A2KNS4BNS5UTR3 | 1996 | Dengue virus 1 isolate 21814/BR-PE/96, complete genome |
| AGN94872 | 3392 | 1 | Brazil | UTR5CMENS1NS2ANS2BNS3NS4A2KNS4BNS5UTR3 | 1997 | Dengue virus 1 isolate 40604/BR-PE/97, complete genome |
| AGN94873 | 3392 | 1 | Brazil | UTR5CMENS1NS2ANS2BNS3NS4A2KNS4BNS5UTR3 | 1997 | Dengue virus 1 isolate 41111/BR-PE/97, complete genome |
| AGN94874 | 3392 | 1 | Brazil | UTR5CMENS1NS2ANS2BNS3NS4A2KNS4BNS5UTR3 | 1998 | Dengue virus 1 isolate 52082/BR-PE/98, complete genome |
| AGN94875 | 3392 | 1 | Brazil | UTR5CMENS1NS2ANS2BNS3NS4A2KNS4BNS5UTR3 | 1999 | Dengue virus 1 isolate 59049/BR-PE/99, complete genome |

TABLE 35-continued

| GenBank Accession | Length | Type | Country | Genome Region | Collection Date | Virus Name |
|---|---|---|---|---|---|---|
| Full-length Dengue Amino Acid Sequences (*Homo sapiens* strains; Brazil, Cuba and U.S.) | | | | | | |
| AGN94876 | 3392 | 1 | Brazil | UTR5CMENS1NS 2ANS2BNS3NS4 A2KNS4BNS5UT R3 | 2000 | Dengue virus 1 isolate 70523/BR-PE/00, complete genome |
| AGN94877 | 3392 | 1 | Brazil | UTR5CMENS1NS 2ANS2BNS3NS4 A2KNS4BNS5UT R3 | 2001 | Dengue virus 1 isolate 74488/BR-PE/01, complete genome |
| AGN94878 | 3392 | 1 | Brazil | UTR5CMENS1NS 2ANS2BNS3NS4 A2KNS4BNS5UT R3 | 2001 | Dengue virus 1 isolate 75861/BR-PE/01, complete genome |
| AGN94879 | 3392 | 1 | Brazil | UTR5CMENS1NS 2ANS2BNS3NS4 A2KNS4BNS5UT R3 | 2002 | Dengue virus 1 isolate 88463/BR-PE/02, complete genome |
| AGN94865 | 3392 | 1 | Brazil | UTR5CMENS1NS 2ANS2BNS3NS4 A2KNS4BNS5UT R3 | 2010 | Dengue virus 1 isolate 9808/BR-PE/10, complete genome |
| ACO06150 | 3392 | 1 | Brazil | UTR5CMENS1NS 2ANS2BNS3NS4 A2KNS4BNS5UT R3 | 2000 | Dengue virus 1 isolate DENV-1/BR/BID-V2374/2000, complete genome |
| ACO06151 | 3392 | 1 | Brazil | UTR5CMENS1NS 2ANS2BNS3NS4 A2KNS4BNS5UT R3 | 2000 | Dengue virus 1 isolate DENV-1/BR/BID-V2375/2000, complete genome |
| ACO06153 | 3392 | 1 | Brazil | UTR5CMENS1NS 2ANS2BNS3NS4 A2KNS4BNS5UT R3 | 2001 | Dengue virus 1 isolate DENV-1/BR/BID-V2378/2001, complete genome |
| ACO06155 | 3392 | 1 | Brazil | UTR5CMENS1NS 2ANS2BNS3NS4 A2KNS4BNS5UT R3 | 2002 | Dengue virus 1 isolate DENV-1/BR/BID-V2381/2002, complete genome |
| ACO06157 | 3392 | 1 | Brazil | UTR5CMENS1NS 2ANS2BNS3NS4 A2KNS4BNS5UT R3 | 2003 | Dengue virus 1 isolate DENV-1/BR/BID-V2384/2003, complete genome |
| ACO06161 | 3392 | 1 | Brazil | UTR5CMENS1NS 2ANS2BNS3NS4 A2KNS4BNS5UT R3 | 2004 | Dengue virus 1 isolate DENV-1/BR/BID-V2389/2004, complete genome |
| ACO06164 | 3392 | 1 | Brazil | UTR5CMENS1NS 2ANS2BNS3NS4 A2KNS4BNS5UT R3 | 2005 | Dengue virus 1 isolate DENV-1/BR/BID-V2392/2005, complete genome |
| ACO06167 | 3392 | 1 | Brazil | UTR5CMENS1NS 2ANS2BNS3NS4 A2KNS4BNS5UT R3 | 2006 | Dengue virus 1 isolate DENV-1/BR/BID-V2395/2006, complete genome |
| ACO06170 | 3392 | 1 | Brazil | UTR5CMENS1NS 2ANS2BNS3NS4 A2KNS4BNS5UT R3 | 2007 | Dengue virus 1 isolate DENV-1/BR/BID-V2398/2007, complete genome |
| ACO06173 | 3392 | 1 | Brazil | UTR5CMENS1NS 2ANS2BNS3NS4 A2KNS4BNS5UT R3 | 2008 | Dengue virus 1 isolate DENV-1/BR/BID-V2401/2008, complete genome |
| ACY70762 | 3392 | 1 | Brazil | UTR5CMENS1NS 2ANS2BNS3NS4 A2KNS4BNS5 | 2008 | Dengue virus 1 isolate DENV-1/BR/BID-V3490/2008, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACJ12617 | 3392 | 1 | Brazil | UTR5CMENS1NS2ANS2BNS3NS4A2KNS4BNS5UTR3 | | Dengue virus 1 isolate DF01-HUB01021093, complete genome |
| AHC08447 | 3392 | 1 | Brazil | CMENS1NS2ANS2BNS3NS4A2KNS4BNS5 | 2011 | Dengue virus 1 strain 1266/2011/BR/RJ/2011 polyprotein gene, partial cds |
| AHC08446 | 3392 | 1 | Brazil | CMENS1NS2ANS2BNS3NS4A2KNS4BNS5 | 2010 | Dengue virus 1 strain 242/2010/BR/RJ/2010 polyprotein gene, partial cds |
| AHC08448 | 3392 | 1 | Brazil | CMENS1NS2ANS2BNS3NS4A2KNS4BNS5 | 1988 | Dengue virus 1 strain 36034/BR/RJ/1988 polyprotein gene, partial cds |
| AHC08449 | 3392 | 1 | Brazil | CMENS1NS2ANS2BNS3NS4A2KNS4BNS5 | 1989 | Dengue virus 1 strain 38159/BR/RJ/1989 polyprotein gene, partial cds |
| AHC08450 | 3392 | 1 | Brazil | CMENS1NS2ANS2BNS3NS4A2KNS4BNS5 | 2000 | Dengue virus 1 strain 66694/BR/ES/2000 polyprotein gene, partial cds |
| AHC08451 | 3392 | 1 | Brazil | CMENS1NS2ANS2BNS3NS4A2KNS4BNS5 | 2001 | Dengue virus 1 strain 68826/BR/RJ/2001 polyprotein gene, partial cds |
| AGN94880 | 3391 | 2 | Brazil | UTR5CMENS1NS2ANS2BNS3NS4A2KNS4BNS5UTR3 | 2010 | Dengue virus 2 isolate 13858/BR-PE/10, complete genome |
| AGN94881 | 3391 | 2 | Brazil | UTR5CMENS1NS2ANS2BNS3NS4A2KNS4BNS5UTR3 | 2010 | Dengue virus 2 isolate 14905/BR-PE/10, complete genome |
| AGN94882 | 3391 | 2 | Brazil | UTR5CMENS1NS2ANS2BNS3NS4A2KNS4BNS5UTR3 | 2010 | Dengue virus 2 isolate 19190/BR-PE/10, complete genome |
| AGN94884 | 3391 | 2 | Brazil | UTR5CMENS1NS2ANS2BNS3NS4A2KNS4BNS5UTR3 | 1995 | Dengue virus 2 isolate 3275/BR-PE/95, complete genome |
| AGN94885 | 3391 | 2 | Brazil | UTR5CMENS1NS2ANS2BNS3NS4A2KNS4BNS5UTR3 | 1995 | Dengue virus 2 isolate 3311/BR-PE/95, complete genome |
| AGN94886 | 3391 | 2 | Brazil | UTR5CMENS1NS2ANS2BNS3NS4A2KNS4BNS5UTR3 | 1995 | Dengue virus 2 isolate 3337/BR-PE/95, complete genome |
| AGN94887 | 3391 | 2 | Brazil | UTR5CMENS1NS2ANS2BNS3NS4A2KNS4BNS5UTR3 | 1997 | Dengue virus 2 isolate 37473/BR-PE/97, complete genome |
| AGN94888 | 3391 | 2 | Brazil | UTR5CMENS1NS2ANS2BNS3NS4A2KNS4BNS5UTR3 | 1998 | Dengue virus 2 isolate 47913/BR-PE/98, complete genome |
| AGN94889 | 3391 | 2 | Brazil | UTR5CMENS1NS2ANS2BNS3NS4A2KNS4BNS5UTR3 | 1998 | Dengue virus 2 isolate 51347/BR-PE/98, complete genome |
| AGN94890 | 3391 | 2 | Brazil | UTR5CMENS1NS2ANS2BNS3NS4A2KNS4BNS5UTR3 | 1999 | Dengue virus 2 isolate 57135/BR-PE/99, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| AGN94891 | 3391 | 2 | Brazil | UTR5CMENS1NS2ANS2BNS3NS4A2KNS4BNS5UTR3 | 2000 | Dengue virus 2 isolate 72144/BR-PE/00, complete genome |
| AGN94892 | 3391 | 2 | Brazil | UTR5CMENS1NS2ANS2BNS3NS4A2KNS4BNS5UTR3 | 2002 | Dengue virus 2 isolate 87086/BR-PE/02, complete genome |
| AGN94883 | 3391 | 2 | Brazil | UTR5CMENS1NS2ANS2BNS3NS4A2KNS4BNS5UTR3 | 2010 | Dengue virus 2 isolate 9479/BR-PE/10, complete genome |
| AGK36299 | 3391 | 2 | Brazil | CMENS1NS2ANS2BNS3NS4A2KNS4BNS5UTR3 | Mar. 30, 2010 | Dengue virus 2 isolate ACS380, complete genome |
| AGK36289 | 3391 | 2 | Brazil | UTR5CMENS1NS2ANS2BNS3NS4A2KNS4BNS5UTR3 | Mar. 1, 2010 | Dengue virus 2 isolate ACS46, complete genome |
| AGK36290 | 3391 | 2 | Brazil | UTR5CMENS1NS2ANS2BNS3NS4A2KNS4BNS5UTR3 | Mar. 1, 2010 | Dengue virus 2 isolate ACS46_II, complete genome |
| AGK36291 | 3391 | 2 | Brazil | UTR5CMENS1NS2ANS2BNS3NS4A2KNS4BNS5UTR3 | Apr. 12, 2010 | Dengue virus 2 isolate ACS538, complete genome |
| AGK36292 | 3391 | 2 | Brazil | UTR5CMENS1NS2ANS2BNS3NS4A2KNS4BNS5UTR3 | May 4, 2010 | Dengue virus 2 isolate ACS542, complete genome |
| AGK36294 | 3391 | 2 | Brazil | UTR5CMENS1NS2ANS2BNS3NS4A2KNS4BNS5UTR3 | May 4, 2010 | Dengue virus 2 isolate ACS721, complete genome |
| ACO06152 | 3391 | 2 | Brazil | UTR5CMENS1NS2ANS2BNS3NS4A2KNS4BNS5UTR3 | 2000 | Dengue virus 2 isolate DENV-2/BR/BID-V2376/2000, complete genome |
| AET43250 | 3391 | 2 | Brazil | CMENS1NS2ANS2BNS3NS4A2KNS4BNS5UTR3 | 2000 | Dengue virus 2 isolate DENV-2/BR/BID-V2377/2000, complete genome |
| ACO06154 | 3391 | 2 | Brazil | UTR5CMENS1NS2ANS2BNS3NS4A2KNS4BNS5UTR3 | 2001 | Dengue virus 2 isolate DENV-2/BR/BID-V2379/2001, complete genome |
| ACO06156 | 3391 | 2 | Brazil | UTR5CMENS1NS2ANS2BNS3NS4A2KNS4BNS5UTR3 | 2002 | Dengue virus 2 isolate DENV-2/BR/BID-V2382/2002, complete genome |
| ACW82928 | 3391 | 2 | Brazil | UTR5CMENS1NS2ANS2BNS3NS4A2KNS4BNS5UTR3 | 2003 | Dengue virus 2 isolate DENV-2/BR/BID-V2385/2003, complete genome |
| ACO06158 | 3391 | 2 | Brazil | UTR5CMENS1NS2ANS2BNS3NS4A2KNS4BNS5UTR3 | 2003 | Dengue virus 2 isolate DENV-2/BR/BID-V2386/2003, complete genome |
| ACO06162 | 3391 | 2 | Brazil | UTR5CMENS1NS2ANS2BNS3NS4A2KNS4BNS5UTR3 | 2004 | Dengue virus 2 isolate DENV-2/BR/BID-V2390/2004, complete genome |
| ACO06165 | 3391 | 2 | Brazil | UTR5CMENS1NS2ANS2BNS3NS4A2KNS4BNS5UTR3 | 2005 | Dengue virus 2 isolate DENV-2/BR/BID-V2393/2005, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACO06168 | 3391 | 2 | Brazil | UTR5CMENS1NS2ANS2BNS3NS4A2KNS4BNS5UTR3 | 2006 | Dengue virus 2 isolate DENV-2/BR/BID-V2396/2006, complete genome |
| ACO06171 | 3391 | 2 | Brazil | UTR5CMENS1NS2ANS2BNS3NS4A2KNS4BNS5UTR3 | 2007 | Dengue virus 2 isolate DENV-2/BR/BID-V2399/2007, complete genome |
| ACS32031 | 3391 | 2 | Brazil | UTR5CMENS1NS2ANS2BNS3NS4A2KNS4BNS5UTR3 | 2008 | Dengue virus 2 isolate DENV-2/BR/BID-V2402/2008, complete genome |
| ACW82873 | 3391 | 2 | Brazil | UTR5CMENS1NS2ANS2BNS3NS4A2KNS4BNS5UTR3 | 2008 | Dengue virus 2 isolate DENV-2/BR/BID-V3481/2008, complete genome |
| ACW82874 | 3391 | 2 | Brazil | UTR5CMENS1NS2ANS2BNS3NS4A2KNS4BNS5UTR3 | 2008 | Dengue virus 2 isolate DENV-2/BR/BID-V3483/2008, complete genome |
| ACW82875 | 3391 | 2 | Brazil | UTR5CMENS1NS2ANS2BNS3NS4A2KNS4BNS5UTR3 | 2008 | Dengue virus 2 isolate DENV-2/BR/BID-V3486/2008, complete genome |
| ACY70763 | 3391 | 2 | Brazil | UTR5CMENS1NS2ANS2BNS3NS4A2KNS4BNS5 | 2008 | Dengue virus 2 isolate DENV-2/BR/BID-V3495/2008, complete genome |
| ADI80655 | 3391 | 2 | Brazil | UTR5CMENS1NS2ANS2BNS3NS4A2KNS4BNS5 | 2008 | Dengue virus 2 isolate DENV-2/BR/BID-V3637/2008, complete genome |
| ACY70778 | 3391 | 2 | Brazil | UTR5CMENS1NS2ANS2BNS3NS4A2KNS4BNS5UTR3 | 2008 | Dengue virus 2 isolate DENV-2/BR/BID-V3638/2008, complete genome |
| ACY70779 | 3391 | 2 | Brazil | UTR5CMENS1NS2ANS2BNS3NS4A2KNS4BNS5 | 2008 | Dengue virus 2 isolate DENV-2/BR/BID-V3640/2008, complete genome |
| ACY70780 | 3391 | 2 | Brazil | UTR5CMENS1NS2ANS2BNS3NS4A2KNS4BNS5 | 2008 | Dengue virus 2 isolate DENV-2/BR/BID-V3644/2008, complete genome |
| ACY70781 | 3391 | 2 | Brazil | UTR5CMENS1NS2ANS2BNS3NS4A2KNS4BNS5UTR3 | 2008 | Dengue virus 2 isolate DENV-2/BR/BID-V3645/2008, complete genome |
| ACY70782 | 3391 | 2 | Brazil | UTR5CMENS1NS2ANS2BNS3NS4A2KNS4BNS5UTR3 | 2008 | Dengue virus 2 isolate DENV-2/BR/BID-V3648/2008, complete genome |
| ACY70783 | 3391 | 2 | Brazil | UTR5CMENS1NS2ANS2BNS3NS4A2KNS4BNS5UTR3 | 2008 | Dengue virus 2 isolate DENV-2/BR/BID-V3650/2008, complete genome |
| ACY70784 | 3391 | 2 | Brazil | UTR5CMENS1NS2ANS2BNS3NS4A2KNS4BNS5UTR3 | 2008 | Dengue virus 2 isolate DENV-2/BR/BID-V3653/2008, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| AGK36297 | 3391 | 2 | Brazil | UTR5CMENS1NS2ANS2BNS3NS4A2KNS4BNS5UTR3 | Apr. 15, 2010 | Dengue virus 2 isolate DGV106, complete genome |
| AGK36295 | 3391 | 2 | Brazil | UTR5CMENS1NS2ANS2BNS3NS4A2KNS4BNS5UTR3 | Feb. 24, 2010 | Dengue virus 2 isolate DGV34, complete genome |
| AGK36293 | 3391 | 2 | Brazil | UTR5CMENS1NS2ANS2BNS3NS4A2KNS4BNS5UTR3 | Feb. 24, 2010 | Dengue virus 2 isolate DGV37, complete genome |
| AGK36298 | 3391 | 2 | Brazil | UTR5CMENS1NS2ANS2BNS3NS4A2KNS4BNS5UTR3 | Mar. 9, 2010 | Dengue virus 2 isolate DGV69, complete genome |
| AGK36296 | 3391 | 2 | Brazil | UTR5CMENS1NS2ANS2BNS3NS4A2KNS4BNS5UTR3 | Mar. 24, 2010 | Dengue virus 2 isolate DGV91, complete genome |
| AFV95788 | 3391 | 2 | Brazil | CMENS1NS2ANS2BNS3NS4A2KNS4BNS5 | 2008 | Dengue virus 2 strain BR0337/2008/RJ/2008 polyprotein gene, partial cds |
| AFV95787 | 3391 | 2 | Brazil | CMENS1NS2ANS2BNS3NS4A2KNS4BNS5 | 2008 | Dengue virus 2 strain BR0450/2008/RJ/2008 polyprotein gene, partial cds |
| ADV39968 | 3391 | 2 | Brazil | CMENS1NS2ANS2BNS3NS4A2KNS4BNS5 | 2008 | Dengue virus 2 strain BR0690/RJ/2008 polyprotein gene, complete cds |
| ADV71220 | 3391 | 2 | Brazil | CMENS1NS2ANS2BNS3NS4A2KNS4BNS5 | 1990 | Dengue virus 2 strain BR39145/RJ/90 polyprotein gene, partial cds |
| ADV71215 | 3391 | 2 | Brazil | CMENS1NS2ANS2BNS3NS4A2KNS4BNS5 | 1990 | Dengue virus 2 strain BR41768/RJ/90 polyprotein gene, partial cds |
| ADV71216 | 3391 | 2 | Brazil | CMENS1NS2ANS2BNS3NS4A2KNS4BNS5 | 1991 | Dengue virus 2 strain BR42727/RJ/91 polyprotein gene, partial cds |
| ADV71217 | 3391 | 2 | Brazil | CMENS1NS2ANS2BNS3NS4A2KNS4BNS5 | 1994 | Dengue virus 2 strain BR48622/CE/94 polyprotein gene, partial cds |
| ADV71218 | 3391 | 2 | Brazil | CMENS1NS2ANS2BNS3NS4A2KNS4BNS5 | 1998 | Dengue virus 2 strain BR61310/RJ/98 polyprotein gene, partial cds |
| ADV71219 | 3391 | 2 | Brazil | CMENS1NS2ANS2BNS3NS4A2KNS4BNS5 | 1999 | Dengue virus 2 strain BR64905/RJ/99 polyprotein gene, partial cds |
| AFH53774 | 3390 | 2 | Brazil | UTR5CMENS1NS2ANS2BNS3NS4A2KNS4BNS5 | | Dengue virus 2 strain JHA1, partial genome |
| AGN94893 | 3390 | 3 | Brazil | UTR5CMENS1NS2ANS2BNS3NS4A2KNS4BNS5UTR3 | 2003 | Dengue virus 3 isolate 101905/BR-PE/03, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| AGN94902 | 3390 | 3 | Brazil | UTR5CMENS1NS2ANS2BNS3NS4A2KNS4BNS5UTR3 | 2004 | Dengue virus 3 isolate 129/BR-PE/04, complete genome |
| AGN94899 | 3390 | 3 | Brazil | UTR5CMENS1NS2ANS2BNS3NS4A2KNS4BNS5UTR3 | 2004 | Dengue virus 3 isolate 145/BR-PE/04, complete genome |
| AGN94903 | 3390 | 3 | Brazil | UTR5CMENS1NS2ANS2BNS3NS4A2KNS4BNS5UTR3 | 2004 | Dengue virus 3 isolate 161/BR-PE/04, complete genome |
| AGN94896 | 3390 | 3 | Brazil | UTR5CMENS1NS2ANS2BNS3NS4A2KNS4BNS5UTR3 | 2005 | Dengue virus 3 isolate 206/BR-PE/05, complete genome |
| AGN94904 | 3390 | 3 | Brazil | UTR5CMENS1NS2ANS2BNS3NS4A2KNS4BNS5UTR3 | 2005 | Dengue virus 3 isolate 249/BR-PE/05, complete genome |
| AGN94901 | 3390 | 3 | Brazil | UTR5CMENS1NS2ANS2BNS3NS4A2KNS4BNS5UTR3 | 2005 | Dengue virus 3 isolate 255/BR-PE/05, complete genome |
| AGN94905 | 3390 | 3 | Brazil | UTR5CMENS1NS2ANS2BNS3NS4A2KNS4BNS5UTR3 | 2005 | Dengue virus 3 isolate 263/BR-PE/05, complete genome |
| AGN94898 | 3390 | 3 | Brazil | UTR5CMENS1NS2ANS2BNS3NS4A2KNS4BNS5UTR3 | 2005 | Dengue virus 3 isolate 277/BR-PE/05, complete genome |
| AGN94906 | 3390 | 3 | Brazil | UTR5CMENS1NS2ANS2BNS3NS4A2KNS4BNS5UTR3 | 2005 | Dengue virus 3 isolate 283/BR-PE/05, complete genome |
| AGN94907 | 3390 | 3 | Brazil | UTR5CMENS1NS2ANS2BNS3NS4A2KNS4BNS5UTR3 | 2005 | Dengue virus 3 isolate 314/BR-PE/06, complete genome |
| AGN94897 | 3390 | 3 | Brazil | UTR5CMENS1NS2ANS2BNS3NS4A2KNS4BNS5UTR3 | 2005 | Dengue virus 3 isolate 339/BR-PE/05, complete genome |
| AGN94908 | 3390 | 3 | Brazil | UTR5CMENS1NS2ANS2BNS3NS4A2KNS4BNS5UTR3 | 2006 | Dengue virus 3 isolate 411/BR-PE/06, complete genome |
| AGN94909 | 3390 | 3 | Brazil | UTR5CMENS1NS2ANS2BNS3NS4A2KNS4BNS5UTR3 | 2006 | Dengue virus 3 isolate 418/BR-PE/06, complete genome |
| AGN94910 | 3390 | 3 | Brazil | UTR5CMENS1NS2ANS2BNS3NS4A2KNS4BNS5UTR3 | 2006 | Dengue virus 3 isolate 420/BR-PE/06, complete genome |
| AGN94911 | 3390 | 3 | Brazil | UTR5CMENS1NS2ANS2BNS3NS4A2KNS4BNS5UTR3 | 2006 | Dengue virus 3 isolate 423/BR-PE/06, complete genome |
| AGN94912 | 3390 | 3 | Brazil | UTR5CMENS1NS2ANS2BNS3NS4A2KNS4BNS5UTR3 | 2006 | Dengue virus 3 isolate 424/BR-PE/06, complete genome |
| AGN94900 | 3390 | 3 | Brazil | UTR5CMENS1NS2ANS2BNS3NS4A2KNS4BNS5UTR3 | 2006 | Dengue virus 3 isolate 603/BR-PE/06, complete genome |
| AGN94895 | 3390 | 3 | Brazil | UTR5CMENS1NS2ANS2BNS3NS4A2KNS4BNS5UTR3 | 2002 | Dengue virus 3 isolate 81257/BR-PE/02, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| AGN94894 | 3390 | 3 | Brazil | UTR5CMENS1NS 2ANS2BNS3NS4 A2KNS4BNS5UT R3 | 2002 | Dengue virus 3 isolate 85469/BR-PE/02, complete genome |
| AFK83756 | 3390 | 3 | Brazil | UTR5CMENS1NS 2ANS2BNS3NS4 A2KNS4BNS5UT R3 | 2007 | Dengue virus 3 isolate D3BR/ACN/2007, complete genome |
| AFK83755 | 3390 | 3 | Brazil | UTR5CMENS1NS 2ANS2BNS3NS4 A2KNS4BNS5UT R3 | 2009 | Dengue virus 3 isolate D3BR/AL95/2009, complete genome |
| AFK83754 | 3390 | 3 | Brazil | UTR5CMENS1NS 2ANS2BNS3NS4 A2KNS4BNS5UT R3 | 2004 | Dengue virus 3 isolate D3BR/BR8/04, complete genome |
| AFK83753 | 3390 | 3 | Brazil | UTR5CMENS1NS 2ANS2BNS3NS4 A2KNS4BNS5UT R3 | 2002 | Dengue virus 3 isolate D3BR/BV4/02, complete genome |
| AFK83762 | 3390 | 3 | Brazil | UTR5CMENS1NS 2ANS2BNS3NS4 A2KNS4BNS5UT R3 | 2002 | Dengue virus 3 isolate D3BR/CU6/02, complete genome |
| AFK83759 | 3390 | 3 | Brazil | UTR5CMENS1NS 2ANS2BNS3NS4 A2KNS4BNS5UT R3 | 2003 | Dengue virus 3 isolate D3BR/MR9/03, complete genome |
| AFK83761 | 3390 | 3 | Brazil | UTR5CMENS1NS 2ANS2BNS3NS4 A2KNS4BNS5UT R3 | 2003 | Dengue virus 3 isolate D3BR/PV1/03, complete genome |
| AFK83760 | 3390 | 3 | Brazil | UTR5CMENS1NS 2ANS2BNS3NS4 A2KNS4BNS5UT R3 | 2002 | Dengue virus 3 isolate D3BR/SL3/02, complete genome |
| AHG23238 | 3390 | 3 | Brazil | UTR5CMENS1NS 2ANS2BNS3NS4 A2KNS4BNS5 | 2002 | Dengue virus 3 isolate DENV-3/BR/BID-V2383/2002, complete genome |
| ACO06159 | 3390 | 3 | Brazil | UTR5CMENS1NS 2ANS2BNS3NS4 A2KNS4BNS5UT R3 | 2003 | Dengue virus 3 isolate DENV-3/BR/BID-V2387/2003, complete genome |
| ACO06160 | 3390 | 3 | Brazil | UTR5CMENS1NS 2ANS2BNS3NS4 A2KNS4BNS5UT R3 | 2003 | Dengue virus 3 isolate DENV-3/BR/BID-V2388/2003, complete genome |
| ACO06163 | 3390 | 3 | Brazil | UTR5CMENS1NS 2ANS2BNS3NS4 A2KNS4BNS5UT R3 | 2004 | Dengue virus 3 isolate DENV-3/BR/BID-V2391/2004, complete genome |
| ACO06166 | 3390 | 3 | Brazil | UTR5CMENS1NS 2ANS2BNS3NS4 A2KNS4BNS5UT R3 | 2005 | Dengue virus 3 isolate DENV-3/BR/BID-V2394/2005, complete genome |
| ACO06169 | 3390 | 3 | Brazil | UTR5CMENS1NS 2ANS2BNS3NS4 A2KNS4BNS5UT R3 | 2006 | Dengue virus 3 isolate DENV-3/BR/BID-V2397/2006, complete genome |
| ACO06172 | 3390 | 3 | Brazil | UTR5CMENS1NS 2ANS2BNS3NS4 A2KNS4BNS5UT R3 | 2007 | Dengue virus 3 isolate DENV-3/BR/BID-V2400/2007, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACO06174 | 3390 | 3 | Brazil | UTR5CMENS1NS2ANS2BNS3NS4A2KNS4BNS5UTR3 | 2008 | Dengue virus 3 isolate DENV-3/BR/BID-V2403/2008, complete genome |
| ACQ44485 | 3390 | 3 | Brazil | UTR5CMENS1NS2ANS2BNS3NS4A2KNS4BNS5UTR3 | 2001 | Dengue virus 3 isolate DENV-3/BR/BID-V2977/2001, complete genome |
| ACQ44486 | 3390 | 3 | Brazil | UTR5CMENS1NS2ANS2BNS3NS4A2KNS4BNS5UTR3 | 2003 | Dengue virus 3 isolate DENV-3/BR/BID-V2983/2003, complete genome |
| ACY70743 | 3390 | 3 | Brazil | UTR5CMENS1NS2ANS2BNS3NS4A2KNS4BNS5UTR3 | 2006 | Dengue virus 3 isolate DENV-3/BR/BID-V3417/2006, complete genome |
| ACY70744 | 3390 | 3 | Brazil | UTR5CMENS1NS2ANS2BNS3NS4A2KNS4BNS5 | 2006 | Dengue virus 3 isolate DENV-3/BR/BID-V3423/2006, complete genome |
| ACY70745 | 3390 | 3 | Brazil | UTR5CMENS1NS2ANS2BNS3NS4A2KNS4BNS5UTR3 | 2006 | Dengue virus 3 isolate DENV-3/BR/BID-V3424/2006, complete genome |
| ACY70746 | 3390 | 3 | Brazil | UTR5CMENS1NS2ANS2BNS3NS4A2KNS4BNS5 | 2006 | Dengue virus 3 isolate DENV-3/BR/BID-V3427/2006, complete genome |
| ACY70747 | 3390 | 3 | Brazil | UTR5CMENS1NS2ANS2BNS3NS4A2KNS4BNS5 | 2006 | Dengue virus 3 isolate DENV-3/BR/BID-V3429/2006, complete genome |
| ACY70748 | 3390 | 3 | Brazil | UTR5CMENS1NS2ANS2BNS3NS4A2KNS4BNS5 | 2006 | Dengue virus 3 isolate DENV-3/BR/BID-V3430/2006, complete genome |
| ACW82870 | 3390 | 3 | Brazil | UTR5CMENS1NS2ANS2BNS3NS4A2KNS4BNS5UTR3 | 2006 | Dengue virus 3 isolate DENV-3/BR/BID-V3431/2006, complete genome |
| ACY70749 | 3390 | 3 | Brazil | UTR5CMENS1NS2ANS2BNS3NS4A2KNS4BNS5 | 2006 | Dengue virus 3 isolate DENV-3/BR/BID-V3434/2006, complete genome |
| ACY70750 | 3390 | 3 | Brazil | UTR5CMENS1NS2ANS2BNS3NS4A2KNS4BNS5 | 2006 | Dengue virus 3 isolate DENV-3/BR/BID-V3435/2006, complete genome |
| ACY70751 | 3390 | 3 | Brazil | UTR5CMENS1NS2ANS2BNS3NS4A2KNS4BNS5 | 2006 | Dengue virus 3 isolate DENV-3/BR/BID-V3441/2006, complete genome |
| ACY70752 | 3390 | 3 | Brazil | UTR5CMENS1NS2ANS2BNS3NS4A2KNS4BNS5 | 2006 | Dengue virus 3 isolate DENV-3/BR/BID-V3442/2006, complete genome |
| ACW82871 | 3390 | 3 | Brazil | UTR5CMENS1NS2ANS2BNS3NS4A2KNS4BNS5UTR3 | 2006 | Dengue virus 3 isolate DENV-3/BR/BID-V3444/2006, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACY70753 | 3390 | 3 | Brazil | UTR5CMENS1NS2ANS2BNS3NS4A2KNS4BNS5 | 2006 | Dengue virus 3 isolate DENV-3/BR/BID-V3446/2006, complete genome |
| ACY70754 | 3390 | 3 | Brazil | UTR5CMENS1NS2ANS2BNS3NS4A2KNS4BNS5UTR3 | 2006 | Dengue virus 3 isolate DENV-3/BR/BID-V3451/2006, complete genome |
| ACY70755 | 3390 | 3 | Brazil | UTR5CMENS1NS2ANS2BNS3NS4A2KNS4BNS5UTR3 | 2006 | Dengue virus 3 isolate DENV-3/BR/BID-V3456/2006, complete genome |
| ACY70756 | 3390 | 3 | Brazil | UTR5CMENS1NS2ANS2BNS3NS4A2KNS4BNS5UTR3 | 2006 | Dengue virus 3 isolate DENV-3/BR/BID-V3457/2006, complete genome |
| ACY70757 | 3390 | 3 | Brazil | UTR5CMENS1NS2ANS2BNS3NS4A2KNS4BNS5 | 2006 | Dengue virus 3 isolate DENV-3/BR/BID-V3460/2006, complete genome |
| ACW82872 | 3390 | 3 | Brazil | UTR5CMENS1NS2ANS2BNS3NS4A2KNS4BNS5UTR3 | 2006 | Dengue virus 3 isolate DENV-3/BR/BID-V3463/2006, complete genome |
| ACY70758 | 3390 | 3 | Brazil | UTR5CMENS1NS2ANS2BNS3NS4A2KNS4BNS5 | 2006 | Dengue virus 3 isolate DENV-3/BR/BID-V3464/2006, complete genome |
| ACY70759 | 3390 | 3 | Brazil | UTR5CMENS1NS2ANS2BNS3NS4A2KNS4BNS5 | 2006 | Dengue virus 3 isolate DENV-3/BR/BID-V3465/2006, complete genome |
| ACY70760 | 3390 | 3 | Brazil | UTR5CMENS1NS2ANS2BNS3NS4A2KNS4BNS5 | 2007 | Dengue virus 3 isolate DENV-3/BR/BID-V3469/2007, complete genome |
| ACY70761 | 3390 | 3 | Brazil | UTR5CMENS1NS2ANS2BNS3NS4A2KNS4BNS5 | 2007 | Dengue virus 3 isolate DENV-3/BR/BID-V3470/2007, complete genome |
| ACY70764 | 3390 | 3 | Brazil | UTR5CMENS1NS2ANS2BNS3NS4A2KNS4BNS5 | 2006 | Dengue virus 3 isolate DENV-3/BR/BID-V3584/2006, complete genome |
| ACY70765 | 3390 | 3 | Brazil | UTR5CMENS1NS2ANS2BNS3NS4A2KNS4BNS5 | 2007 | Dengue virus 3 isolate DENV-3/BR/BID-V3585/2007, complete genome |
| ACY70766 | 3390 | 3 | Brazil | UTR5CMENS1NS2ANS2BNS3NS4A2KNS4BNS5 | 2007 | Dengue virus 3 isolate DENV-3/BR/BID-V3588/2007, complete genome |
| ACY70767 | 3390 | 3 | Brazil | UTR5CMENS1NS2ANS2BNS3NS4A2KNS4BNS5 | 2007 | Dengue virus 3 isolate DENV-3/BR/BID-V3589/2007, complete genome |
| ACY70768 | 3390 | 3 | Brazil | UTR5CMENS1NS2ANS2BNS3NS4A2KNS4BNS5 | 2007 | Dengue virus 3 isolate DENV-3/BR/BID-V3590/2007, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACY70769 | 3390 | 3 | Brazil | UTR5CMENS1NS2ANS2BNS3NS4A2KNS4BNS5 | 2007 | Dengue virus 3 isolate DENV-3/BR/BID-V3591/2007, complete genome |
| ACY70770 | 3390 | 3 | Brazil | UTR5CMENS1NS2ANS2BNS3NS4A2KNS4BNS5 | 2007 | Dengue virus 3 isolate DENV-3/BR/BID-V3593/2007, complete genome |
| ACY70771 | 3390 | 3 | Brazil | UTR5CMENS1NS2ANS2BNS3NS4A2KNS4BNS5UTR3 | 2007 | Dengue virus 3 isolate DENV-3/BR/BID-V3597/2007, complete genome |
| ACY70772 | 3390 | 3 | Brazil | UTR5CMENS1NS2ANS2BNS3NS4A2KNS4BNS5 | 2007 | Dengue virus 3 isolate DENV-3/BR/BID-V3598/2007, complete genome |
| ACY70773 | 3390 | 3 | Brazil | UTR5CMENS1NS2ANS2BNS3NS4A2KNS4BNS5 | 2007 | Dengue virus 3 isolate DENV-3/BR/BID-V3601/2007, complete genome |
| ACY70774 | 3390 | 3 | Brazil | UTR5CMENS1NS2ANS2BNS3NS4A2KNS4BNS5 | 2007 | Dengue virus 3 isolate DENV-3/BR/BID-V3605/2007, complete genome |
| ACY70775 | 3390 | 3 | Brazil | UTR5CMENS1NS2ANS2BNS3NS4A2KNS4BNS5 | 2007 | Dengue virus 3 isolate DENV-3/BR/BID-V3606/2007, complete genome |
| ACY70776 | 3390 | 3 | Brazil | UTR5CMENS1NS2ANS2BNS3NS4A2KNS4BNS5UTR3 | 2007 | Dengue virus 3 isolate DENV-3/BR/BID-V3609/2007, complete genome |
| ACY70777 | 3390 | 3 | Brazil | UTR5CMENS1NS2ANS2BNS3NS4A2KNS4BNS5UTR3 | 2007 | Dengue virus 3 isolate DENV-3/BR/BID-V3615/2007, complete genome |
| AEV42062 | 3390 | 3 | Brazil | UTR5CMENS1NS2ANS2BNS3NS4A2KNS4BNS5UTR3 | 2006 | Dengue virus 3 isolate DENV3/BR/D3LIMHO/2006, complete genome |
| AGH08164 | 3390 | 3 | Brazil | UTR5CMENS1NS2ANS2BNS3NS4A2KNS4BNS5UTR3 | 2002 | Dengue virus 3 strain 95016/BR-PE/02, complete genome |
| AEX91754 | 3387 | 4 | Brazil | UTR5CMENS1NS2ANS2BNS3NS4A2KNS4BNS5UTR3 | Sep. 8, 2010 | Dengue virus 4 isolate Br246RR/10, complete genome |
| AIQ84223 | 3387 | 4 | Brazil | UTR5CMENS1NS2ANS2BNS3NS4A2KNS4BNS5UTR3 | Mar. 28, 2012 | Dengue virus 4 strain DENV-4/MT/BR12_TVP17898/2012 isolate serum_12, complete genome |
| AIQ84224 | 3387 | 4 | Brazil | UTR5CMENS1NS2ANS2BNS3NS4A2KNS4BNS5UTR3 | Mar. 30, 2012 | Dengue virus 4 strain DENV-4/MT/BR20_TVP17906/2012 isolate serum_20, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| AIQ84225 | 3387 | 4 | Brazil | UTR5CMENS1NS2ANS2BNS3NS4A2KNS4BNS5UTR3 | Mar. 30, 2012 | Dengue virus 4 strain DENV-4/MT/BR23_TVP17909/2012 isolate serum_23, complete genome |
| AIQ84226 | 3387 | 4 | Brazil | UTR5CMENS1NS2ANS2BNS3NS4A2KNS4BNS5UTR3 | Apr. 19, 2012 | Dengue virus 4 strain DENV-4/MT/BR24_TVP17910/2012 isolate serum_24, complete genome |
| AIQ84227 | 3387 | 4 | Brazil | UTR5CMENS1NS2ANS2BNS3NS4A2KNS4BNS5UTR3 | Apr. 12, 2012 | Dengue virus 4 strain DENV-4/MT/BR27_TVP17913/2012 isolate serum_27, complete genome |
| AIQ84228 | 3387 | 4 | Brazil | UTR5CMENS1NS2ANS2BNS3NS4A2KNS4BNS5UTR3 | Apr. 19, 2012 | Dengue virus 4 strain DENV-4/MT/BR28_TVP17914/2012 isolate serum_28, complete genome |
| AIQ84220 | 3387 | 4 | Brazil | UTR5CMENS1NS2ANS2BNS3NS4A2KNS4BNS5UTR3 | Apr. 23, 2012 | Dengue virus 4 strain DENV-4/MT/BR2_TVP17888/2012 isolate serum_2, complete genome |
| AIQ84245 | 3387 | 4 | Brazil | UTR5CMENS1NS2ANS2BNS3NS4A2KNS4BNS5UTR3 | Apr. 20, 2012 | Dengue virus 4 strain DENV-4/MT/BR33_TVP17919/2012 isolate serum_33, complete genome |
| AIQ84244 | 3387 | 4 | Brazil | UTR5CMENS1NS2ANS2BNS3NS4A2KNS4BNS5UTR3 | Mar. 30, 2012 | Dengue virus 4 strain DENV-4/MT/BR35_TVP17921/2012 isolate serum_35, complete genome |
| AIQ84243 | 3387 | 4 | Brazil | UTR5CMENS1NS2ANS2BNS3NS4A2KNS4BNS5UTR3 | Apr. 3, 2012 | Dengue virus 4 strain DENV-4/MT/BR40_TVP17926/2012 isolate serum_40, complete genome |
| AIQ84242 | 3387 | 4 | Brazil | UTR5CMENS1NS2ANS2BNS3NS4A2KNS4BNS5UTR3 | Apr. 5, 2012 | Dengue virus 4 strain DENV-4/MT/BR44_TVP17930/2012 isolate serum_44, complete genome |
| AIQ84241 | 3387 | 4 | Brazil | UTR5CMENS1NS2ANS2BNS3NS4A2KNS4BNS5UTR3 | Mar. 23, 2012 | Dengue virus 4 strain DENV-4/MT/BR47_TVP17933/2012 isolate serum_47, complete genome |
| AIQ84240 | 3387 | 4 | Brazil | UTR5CMENS1NS2ANS2BNS3NS4A2KNS4BNS5UTR3 | Mar. 21, 2012 | Dengue virus 4 strain DENV-4/MT/BR48_TVP17934/2012 isolate serum_48, complete genome |
| AIQ84239 | 3387 | 4 | Brazil | UTR5CMENS1NS2ANS2BNS3NS4A2KNS4BNS5UTR3 | Mar. 12, 2012 | Dengue virus 4 strain DENV-4/MT/BR50_TVP18148/2012 isolate serum_50, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| AIQ84238 | 3387 | 4 | Brazil | UTR5CMENS1NS2ANS2BNS3NS4A2KNS4BNS5UTR3 | Mar. 20, 2012 | Dengue virus 4 strain DENV-4/MT/BR52_TVP17938/2012 isolate serum_52, complete genome |
| AIQ84237 | 3387 | 4 | Brazil | UTR5CMENS1NS2ANS2BNS3NS4A2KNS4BNS5UTR3 | Mar. 14, 2012 | Dengue virus 4 strain DENV-4/MT/BR53_TVP17939/2012 isolate serum_53, complete genome |
| AIQ84236 | 3387 | 4 | Brazil | UTR5CMENS1NS2ANS2BNS3NS4A2KNS4BNS5UTR3 | Mar. 14, 2012 | Dengue virus 4 strain DENV-4/MT/BR55_TVP17941/2012 isolate serum_55, complete genome |
| AIQ84235 | 3387 | 4 | Brazil | UTR5CMENS1NS2ANS2BNS3NS4A2KNS4BNS5UTR3 | Mar. 14, 2012 | Dengue virus 4 strain DENV-4/MT/BR60_TVP17946/2012 isolate serum_60, complete genome |
| AIQ84234 | 3387 | 4 | Brazil | UTR5CMENS1NS2ANS2BNS3NS4A2KNS4BNS5UTR3 | Apr. 19, 2012 | Dengue virus 4 strain DENV-4/MT/BR73_TVP17951/2012 isolate serum_73, complete genome |
| AIQ84233 | 3387 | 4 | Brazil | UTR5CMENS1NS2ANS2BNS3NS4A2KNS4BNS5UTR3 | Apr. 19, 2012 | Dengue virus 4 strain DENV-4/MT/BR76_TVP17953/2012 isolate serum_76, complete genome |
| AIQ84232 | 3387 | 4 | Brazil | UTR5CMENS1NS2ANS2BNS3NS4A2KNS4BNS5UTR3 | Feb. 3, 2012 | Dengue virus 4 strain DENV-4/MT/BR84_TVP17961/2012 isolate serum_84, complete genome |
| AIQ84221 | 3387 | 4 | Brazil | UTR5CMENS1NS2ANS2BNS3NS4A2KNS4BNS5UTR3 | Apr. 23, 2012 | Dengue virus 4 strain DENV-4/MT/BR8_TVP17894/2012 isolate serum_8, complete genome |
| AIQ84231 | 3387 | 4 | Brazil | UTR5CMENS1NS2ANS2BNS3NS4A2KNS4BNS5UTR3 | Feb. 3, 2012 | Dengue virus 4 strain DENV-4/MT/BR91_TVP17968/2012 isolate serum_91, complete genome |
| AIQ84230 | 3387 | 4 | Brazil | UTR5CMENS1NS2ANS2BNS3NS4A2KNS4BNS5UTR3 | Feb. 29, 2012 | Dengue virus 4 strain DENV-4/MT/BR92_TVP17969/2012 isolate serum_92, complete genome |
| AIQ84229 | 3387 | 4 | Brazil | UTR5CMENS1NS2ANS2BNS3NS4A2KNS4BNS5UTR3 | Feb. 16, 2012 | Dengue virus 4 strain DENV-4/MT/BR94_TVP17971/2012 isolate serum_94, complete genome |
| AIQ84222 | 3387 | 4 | Brazil | UTR5CMENS1NS2ANS2BNS3NS4A2KNS4BNS5UTR3 | Apr. 18, 2012 | Dengue virus 4 strain DENV-4/MT/BR9_TVP17895/2012 isolate serum_9, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| AEW50182 | 3387 | 4 | Brazil | UTR5CMENS1NS2ANS2BNS3NS4A2KNS4BNS5 | Mar. 26, 1982 | Dengue virus 4 strain H402276, complete genome |
| AFX65866 | 3387 | 4 | Brazil | UTR5CMENS1NS2ANS2BNS3NS4A2KNS4BNS5UTR3 | Jul. 17, 2010 | Dengue virus 4 strain H772846, complete genome |
| AFX65867 | 3387 | 4 | Brazil | UTR5CMENS1NS2ANS2BNS3NS4A2KNS4BNS5UTR3 | Jul. 18, 2010 | Dengue virus 4 strain H772852, complete genome |
| AEW50183 | 3387 | 4 | Brazil | UTR5CMENS1NS2ANS2BNS3NS4A2KNS4BNS5 | Jul. 21, 2010 | Dengue virus 4 strain H772854, complete genome |
| AFX65868 | 3387 | 4 | Brazil | UTR5CMENS1NS2ANS2BNS3NS4A2KNS4BNS5UTR3 | Aug. 20, 2010 | Dengue virus 4 strain H773583, complete genome |
| AFX65869 | 3387 | 4 | Brazil | UTR5CMENS1NS2ANS2BNS3NS4A2KNS4BNS5UTR3 | Aug. 24, 2010 | Dengue virus 4 strain H774846, complete genome |
| AFX65870 | 3387 | 4 | Brazil | UTR5CMENS1NS2ANS2BNS3NS4A2KNS4BNS5UTR3 | Nov. 10, 2010 | Dengue virus 4 strain H775222, complete genome |
| AFX65871 | 3387 | 4 | Brazil | UTR5CMENS1NS2ANS2BNS3NS4A2KNS4BNS5UTR3 | Jan. 12, 2011 | Dengue virus 4 strain H778494, complete genome |
| AFX65872 | 3387 | 4 | Brazil | UTR5CMENS1NS2ANS2BNS3NS4A2KNS4BNS5UTR3 | Jan. 11, 2011 | Dengue virus 4 strain H778504, complete genome |
| AFX65873 | 3387 | 4 | Brazil | UTR5CMENS1NS2ANS2BNS3NS4A2KNS4BNS5UTR3 | Jan. 20, 2011 | Dengue virus 4 strain H778887, complete genome |
| AFX65874 | 3387 | 4 | Brazil | UTR5CMENS1NS2ANS2BNS3NS4A2KNS4BNS5UTR3 | Jan. 14, 2011 | Dengue virus 4 strain H779228, complete genome |
| AFX65875 | 3387 | 4 | Brazil | UTR5CMENS1NS2ANS2BNS3NS4A2KNS4BNS5UTR3 | Jan. 24, 2011 | Dengue virus 4 strain H779652, complete genome |
| AFX65876 | 3387 | 4 | Brazil | UTR5CMENS1NS2ANS2BNS3NS4A2KNS4BNS5UTR3 | Nov. 29, 2010 | Dengue virus 4 strain H780090, complete genome |
| AFX65877 | 3387 | 4 | Brazil | UTR5CMENS1NS2ANS2BNS3NS4A2KNS4BNS5UTR3 | Nov. 21, 2010 | Dengue virus 4 strain H780120, complete genome |
| AFX65878 | 3387 | 4 | Brazil | UTR5CMENS1NS2ANS2BNS3NS4A2KNS4BNS5UTR3 | Jan. 29, 2011 | Dengue virus 4 strain H780556, complete genome |
| AFX65879 | 3387 | 4 | Brazil | UTR5CMENS1NS2ANS2BNS3NS4A2KNS4BNS5UTR3 | Jan. 29, 2011 | Dengue virus 4 strain H780563, complete genome |
| AFX65880 | 3387 | 4 | Brazil | UTR5CMENS1NS2ANS2BNS3NS4A2KNS4BNS5UTR3 | Jan. 13, 2011 | Dengue virus 4 strain H780571, complete genome |
| AFX65881 | 3387 | 4 | Brazil | UTR5CMENS1NS2ANS2BNS3NS4A2KNS4BNS5UTR3 | Mar. 18, 2011 | Dengue virus 4 strain H781363, complete genome |
| AIK23224 | 3391 | 2 | Cuba | CMENS1NS2ANS2BNS3NS4A2KNS4BNS5 | 1981 | Dengue virus 2 isolate Cuba_A115_1981 polyprotein gene, complete cds |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| AIK23223 | 3391 | 2 | Cuba | CMENS1NS2ANS2BNS3NS4A2KNS4BNS5 | 1981 | Dengue virus 2 isolate Cuba_A132_1981 polyprotein gene, complete cds |
| AIK23222 | 3391 | 2 | Cuba | CMENS1NS2ANS2BNS3NS4A2KNS4BNS5 | 1981 | Dengue virus 2 isolate Cuba_A15_1981 polyprotein gene, complete cds |
| AIK23225 | 3391 | 2 | Cuba | CMENS1NS2ANS2BNS3NS4A2KNS4BNS5 | 1981 | Dengue virus 2 isolate Cuba_A169_1981 polyprotein gene, complete cds |
| AIK23226 | 3391 | 2 | Cuba | CMENS1NS2ANS2BNS3NS4A2KNS4BNS5 | 1981 | Dengue virus 2 isolate Cuba_A35_1981 polyprotein gene, complete cds |
| AAW31409 | 3391 | 2 | Cuba | UTR5CMENS1NS2ANS2BNS3NS4A2KNS4BNS5UTR3 | | Dengue virus type 2 strain Cuba115/97, complete genome |
| AAW31407 | 3391 | 2 | Cuba | UTR5CMENS1NS2ANS2BNS3NS4A2KNS4BNS5UTR3 | | Dengue virus type 2 strain Cuba13/97, complete genome |
| AAW31411 | 3391 | 2 | Cuba | UTR5CMENS1NS2ANS2BNS3NS4A2KNS4BNS5UTR3 | | Dengue virus type 2 strain Cuba165/97, complete genome |
| AAW31412 | 3391 | 2 | Cuba | UTR5CMENS1NS2ANS2BNS3NS4A2KNS4BNS5UTR3 | 1997 | Dengue virus type 2 strain Cuba205/97, complete genome |
| AAW31408 | 3391 | 2 | Cuba | UTR5CMENS1NS2ANS2BNS3NS4A2KNS4BNS5UTR3 | | Dengue virus type 2 strain Cuba58/97, complete genome |
| AAW31410 | 3391 | 2 | Cuba | UTR5CMENS1NS2ANS2BNS3NS4A2KNS4BNS5UTR3 | 1997 | Dengue virus type 2 strain Cuba89/97, complete genome |
| AFJ91714 | 3392 | 1 | USA | UTR5CMENS1NS2ANS2BNS3NS4A2KNS4BNS5UTR3 | 2010, October | Dengue virus 1 isolate DENV-1/BOL-KW010, complete genome |
| ACA48834 | 3392 | 1 | USA | UTR5CMENS1NS2ANS2BNS3NS4A2KNS4BNS5UTR3 | 1998 | Dengue virus 1 isolate DENV-1/US/BID-V1162/1998, complete genome |
| ACJ04186 | 3392 | 1 | USA | UTR5CMENS1NS2ANS2BNS3NS4A2KNS4BNS5UTR3 | 1995 | Dengue virus 1 isolate DENV-1/US/BID-V1734/1995, complete genome |
| ACJ04190 | 3392 | 1 | USA | UTR5CMENS1NS2ANS2BNS3NS4A2KNS4BNS5UTR3 | 1998 | Dengue virus 1 isolate DENV-1/US/BID-V1738/1998, complete genome |
| ACH99678 | 3392 | 1 | USA | UTR5CMENS1NS2ANS2BNS3NS4A2KNS4BNS5UTR3 | 1998 | Dengue virus 1 isolate DENV-1/US/BID-V1739/1998, complete genome |
| ACH99679 | 3392 | 1 | USA | UTR5CMENS1NS2ANS2BNS3NS4A2KNS4BNS5UTR3 | 1998 | Dengue virus 1 isolate DENV-1/US/BID-V1740/1998, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACJ04191 | 3392 | 1 | USA | UTR5CMENS1NS2ANS2BNS3NS4A2KNS4BNS5UTR3 | 1998 | Dengue virus 1 isolate DENV-1/US/BID-V1741/1998, complete genome |
| ACJ04192 | 3392 | 1 | USA | UTR5CMENS1NS2ANS2BNS3NS4A2KNS4BNS5UTR3 | 1998 | Dengue virus 1 isolate DENV-1/US/BID-V1742/1998, complete genome |
| ACH99680 | 3392 | 1 | USA | UTR5CMENS1NS2ANS2BNS3NS4A2KNS4BNS5UTR3 | 1995 | Dengue virus 1 isolate DENV-1/US/BID-V1743/1995, complete genome |
| ACH99681 | 3392 | 1 | USA | UTR5CMENS1NS2ANS2BNS3NS4A2KNS4BNS5UTR3 | 1995 | Dengue virus 1 isolate DENV-1/US/BID-V1744/1995, complete genome |
| ACJ04215 | 3392 | 1 | USA | UTR5CMENS1NS2ANS2BNS3NS4A2KNS4BNS5UTR3 | 1998 | Dengue virus 1 isolate DENV-1/US/BID-V2093/1998, complete genome |
| ACJ04216 | 3392 | 1 | USA | UTR5CMENS1NS2ANS2BNS3NS4A2KNS4BNS5UTR3 | 1995 | Dengue virus 1 isolate DENV-1/US/BID-V2094/1995, complete genome |
| ACJ04217 | 3392 | 1 | USA | UTR5CMENS1NS2ANS2BNS3NS4A2KNS4BNS5UTR3 | 1994 | Dengue virus 1 isolate DENV-1/US/BID-V2095/1994, complete genome |
| ACL99012 | 3392 | 1 | USA | UTR5CMENS1NS2ANS2BNS3NS4A2KNS4BNS5UTR3 | 1993 | Dengue virus 1 isolate DENV-1/US/BID-V2096/1993, complete genome |
| ACL99013 | 3392 | 1 | USA | UTR5CMENS1NS2ANS2BNS3NS4A2KNS4BNS5UTR3 | 1986 | Dengue virus 1 isolate DENV-1/US/BID-V2097/1986, complete genome |
| ACJ04221 | 3392 | 1 | USA | UTR5CMENS1NS2ANS2BNS3NS4A2KNS4BNS5UTR3 | 1994 | Dengue virus 1 isolate DENV-1/US/BID-V2127/1994, complete genome |
| ACJ04222 | 3392 | 1 | USA | UTR5CMENS1NS2ANS2BNS3NS4A2KNS4BNS5UTR3 | 1995 | Dengue virus 1 isolate DENV-1/US/BID-V2128/1995, complete genome |
| ACJ04223 | 3392 | 1 | USA | UTR5CMENS1NS2ANS2BNS3NS4A2KNS4BNS5UTR3 | 1995 | Dengue virus 1 isolate DENV-1/US/BID-V2129/1995, complete genome |
| ACL99002 | 3392 | 1 | USA | UTR5CMENS1NS2ANS2BNS3NS4A2KNS4BNS5UTR3 | 1995 | Dengue virus 1 isolate DENV-1/US/BID-V2130/1995, complete genome |
| ACJ04224 | 3392 | 1 | USA | UTR5CMENS1NS2ANS2BNS3NS4A2KNS4BNS5UTR3 | 1996 | Dengue virus 1 isolate DENV-1/US/BID-V2131/1996, complete genome |
| ACJ04225 | 3392 | 1 | USA | UTR5CMENS1NS2ANS2BNS3NS4A2KNS4BNS5UTR3 | 1993 | Dengue virus 1 isolate DENV-1/US/BID-V2132/1993, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACJ04226 | 3392 | 1 | USA | UTR5CMENS1NS2ANS2BNS3NS4A2KNS4BNS5UTR3 | 1993 | Dengue virus 1 isolate DENV-1/US/BID-V2133/1993, complete genome |
| ACJ04227 | 3392 | 1 | USA | UTR5CMENS1NS2ANS2BNS3NS4A2KNS4BNS5UTR3 | 1993 | Dengue virus 1 isolate DENV-1/US/BID-V2134/1993, complete genome |
| ACL99003 | 3392 | 1 | USA | UTR5CMENS1NS2ANS2BNS3NS4A2KNS4BNS5UTR3 | 1992 | Dengue virus 1 isolate DENV-1/US/BID-V2135/1992, complete genome |
| ACJ04228 | 3392 | 1 | USA | UTR5CMENS1NS2ANS2BNS3NS4A2KNS4BNS5UTR3 | 1992 | Dengue virus 1 isolate DENV-1/US/BID-V2136/1992, complete genome |
| ACJ04229 | 3392 | 1 | USA | UTR5CMENS1NS2ANS2BNS3NS4A2KNS4BNS5UTR3 | 1992 | Dengue virus 1 isolate DENV-1/US/BID-V2137/1992, complete genome |
| ACK28188 | 3392 | 1 | USA | UTR5CMENS1NS2ANS2BNS3NS4A2KNS4BNS5UTR3 | 1996 | Dengue virus 1 isolate DENV-1/US/BID-V2138/1996, complete genome |
| ACJ04230 | 3392 | 1 | USA | UTR5CMENS1NS2ANS2BNS3NS4A2KNS4BNS5UTR3 | 1996 | Dengue virus 1 isolate DENV-1/US/BID-V2139/1996, complete genome |
| ACJ04231 | 3392 | 1 | USA | UTR5CMENS1NS2ANS2BNS3NS4A2KNS4BNS5UTR3 | 1996 | Dengue virus 1 isolate DENV-1/US/BID-V2140/1996, complete genome |
| ACK28189 | 3392 | 1 | USA | UTR5CMENS1NS2ANS2BNS3NS4A2KNS4BNS5UTR3 | 1987 | Dengue virus 1 isolate DENV-1/US/BID-V2142/1987, complete genome |
| ACJ04232 | 3392 | 1 | USA | UTR5CMENS1NS2ANS2BNS3NS4A2KNS4BNS5UTR3 | 1987 | Dengue virus 1 isolate DENV-1/US/BID-V2143/1987, complete genome |
| ACA48858 | 3392 | 1 | USA | UTR5CMENS1NS2ANS2BNS3NS4A2KNS4BNS5UTR3 | 2006 | Dengue virus 1 isolate DENV-1/US/BID-V852/2006, complete genome |
| ACA48859 | 3392 | 1 | USA | UTR5CMENS1NS2ANS2BNS3NS4A2KNS4BNS5UTR3 | 1998 | Dengue virus 1 isolate DENV-1/US/BID-V853/1998, complete genome |
| ACF49259 | 3392 | 1 | USA | UTR5CMENS1NS2ANS2BNS3NS4A2KNS4BNS5UTR3 | 1944 | Dengue virus 1 isolate US/Hawaii/1944, complete genome |
| AIU47321 | 3392 | 1 | USA | UTR5CMENS1NS2ANS2BNS3NS4A2KNS4BNS5UTR3 | 1944 | Dengue virus 1 strain Hawaii, complete genome |
| ACA48811 | 3391 | 2 | USA | UTR5CMENS1NS2ANS2BNS3NS4A2KNS4BNS5UTR3 | 2006 | Dengue virus 2 isolate DENV-2/US/BID-V1031/2006, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACA48812 | 3391 | 2 | USA | UTR5CMENS1NS2ANS2BNS3NS4A2KNS4BNS5UTR3 | 1998 | Dengue virus 2 isolate DENV-2/US/BID-V1032/1998, complete genome |
| ACA48813 | 3391 | 2 | USA | UTR5CMENS1NS2ANS2BNS3NS4A2KNS4BNS5UTR3 | 1998 | Dengue virus 2 isolate DENV-2/US/BID-V1033/1998, complete genome |
| ACA48814 | 3391 | 2 | USA | UTR5CMENS1NS2ANS2BNS3NS4A2KNS4BNS5UTR3 | 1998 | Dengue virus 2 isolate DENV-2/US/BID-V1034/1998, complete genome |
| ACA48815 | 3391 | 2 | USA | UTR5CMENS1NS2ANS2BNS3NS4A2KNS4BNS5UTR3 | 2006 | Dengue virus 2 isolate DENV-2/US/BID-V1035/2006, complete genome |
| ACA48816 | 3391 | 2 | USA | UTR5CMENS1NS2ANS2BNS3NS4A2KNS4BNS5UTR3 | 2006 | Dengue virus 2 isolate DENV-2/US/BID-V1036/2006, complete genome |
| ACA48817 | 3391 | 2 | USA | UTR5CMENS1NS2ANS2BNS3NS4A2KNS4BNS5UTR3 | 1998 | Dengue virus 2 isolate DENV-2/US/BID-V1038/1998, complete genome |
| ACA48818 | 3391 | 2 | USA | UTR5CMENS1NS2ANS2BNS3NS4A2KNS4BNS5UTR3 | 2006 | Dengue virus 2 isolate DENV-2/US/BID-V1039/2006, complete genome |
| ACA48819 | 3391 | 2 | USA | UTR5CMENS1NS2ANS2BNS3NS4A2KNS4BNS5UTR3 | 2006 | Dengue virus 2 isolate DENV-2/US/BID-V1040/2006, complete genome |
| ACA48820 | 3391 | 2 | USA | UTR5CMENS1NS2ANS2BNS3NS4A2KNS4BNS5UTR3 | 2006 | Dengue virus 2 isolate DENV-2/US/BID-V1041/2006, complete genome |
| ACA48821 | 3391 | 2 | USA | UTR5CMENS1NS2ANS2BNS3NS4A2KNS4BNS5UTR3 | 1998 | Dengue virus 2 isolate DENV-2/US/BID-V1042/1998, complete genome |
| ACA48823 | 3391 | 2 | USA | UTR5CMENS1NS2ANS2BNS3NS4A2KNS4BNS5UTR3 | 2005 | Dengue virus 2 isolate DENV-2/US/BID-V1045/2005, complete genome |
| ACA58330 | 3391 | 2 | USA | UTR5CMENS1NS2ANS2BNS3NS4A2KNS4BNS5UTR3 | 2004 | Dengue virus 2 isolate DENV-2/US/BID-V1046/2004, complete genome |
| ACA48824 | 3391 | 2 | USA | UTR5CMENS1NS2ANS2BNS3NS4A2KNS4BNS5UTR3 | 1999 | Dengue virus 2 isolate DENV-2/US/BID-V1048/1999, complete genome |
| ACA48827 | 3391 | 2 | USA | UTR5CMENS1NS2ANS2BNS3NS4A2KNS4BNS5UTR3 | 1998 | Dengue virus 2 isolate DENV-2/US/BID-V1052/1998, complete genome |
| ACA48828 | 3391 | 2 | USA | UTR5CMENS1NS2ANS2BNS3NS4A2KNS4BNS5UTR3 | 1996 | Dengue virus 2 isolate DENV-2/US/BID-V1054/1996, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACB29511 | 3391 | 2 | USA | UTR5CMENS1NS2ANS2BNS3NS4A2KNS4BNS5UTR3 | 1996 | Dengue virus 2 isolate DENV-2/US/BID-V1055/1996, complete genome |
| ACA58331 | 3391 | 2 | USA | UTR5CMENS1NS2ANS2BNS3NS4A2KNS4BNS5UTR3 | 1994 | Dengue virus 2 isolate DENV-2/US/BID-V1057/1994, complete genome |
| ACA58332 | 3391 | 2 | USA | UTR5CMENS1NS2ANS2BNS3NS4A2KNS4BNS5UTR3 | 1994 | Dengue virus 2 isolate DENV-2/US/BID-V1058/1994, complete genome |
| ACA48829 | 3391 | 2 | USA | UTR5CMENS1NS2ANS2BNS3NS4A2KNS4BNS5UTR3 | 1989 | Dengue virus 2 isolate DENV-2/US/BID-V1060/1989, complete genome |
| ACD13309 | 3391 | 2 | USA | UTR5CMENS1NS2ANS2BNS3NS4A2KNS4BNS5UTR3 | 1989 | Dengue virus 2 isolate DENV-2/US/BID-V1061/1989, complete genome |
| ACA48832 | 3391 | 2 | USA | UTR5CMENS1NS2ANS2BNS3NS4A2KNS4BNS5UTR3 | 1998 | Dengue virus 2 isolate DENV-2/US/BID-V1084/1998, complete genome |
| ACA58337 | 3391 | 2 | USA | UTR5CMENS1NS2ANS2BNS3NS4A2KNS4BNS5UTR3 | 1994 | Dengue virus 2 isolate DENV-2/US/BID-V1085/1994, complete genome |
| ACA58338 | 3391 | 2 | USA | UTR5CMENS1NS2ANS2BNS3NS4A2KNS4BNS5UTR3 | 1991 | Dengue virus 2 isolate DENV-2/US/BID-V1087/1991, complete genome |
| ACB29512 | 3391 | 2 | USA | UTR5CMENS1NS2ANS2BNS3NS4A2KNS4BNS5UTR3 | 1986 | Dengue virus 2 isolate DENV-2/US/BID-V1163/1986, complete genome |
| ACA48835 | 3391 | 2 | USA | UTR5CMENS1NS2ANS2BNS3NS4A2KNS4BNS5UTR3 | 1986 | Dengue virus 2 isolate DENV-2/US/BID-V1164/1986, complete genome |
| ACA48836 | 3391 | 2 | USA | UTR5CMENS1NS2ANS2BNS3NS4A2KNS4BNS5UTR3 | 1987 | Dengue virus 2 isolate DENV-2/US/BID-V1165/1987, complete genome |
| ACA48837 | 3391 | 2 | USA | UTR5CMENS1NS2ANS2BNS3NS4A2KNS4BNS5UTR3 | 1987 | Dengue virus 2 isolate DENV-2/US/BID-V1166/1987, complete genome |
| ACA48838 | 3391 | 2 | USA | UTR5CMENS1NS2ANS2BNS3NS4A2KNS4BNS5UTR3 | 1987 | Dengue virus 2 isolate DENV-2/US/BID-V1167/1987, complete genome |
| ACA48839 | 3391 | 2 | USA | UTR5CMENS1NS2ANS2BNS3NS4A2KNS4BNS5UTR3 | 1987 | Dengue virus 2 isolate DENV-2/US/BID-V1168/1987, complete genome |
| ACA48840 | 3391 | 2 | USA | UTR5CMENS1NS2ANS2BNS3NS4A2KNS4BNS5UTR3 | 1987 | Dengue virus 2 isolate DENV-2/US/BID-V1169/1987, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACA48841 | 3391 | 2 | USA | UTR5CMENS1NS2ANS2BNS3NS4A2KNS4BNS5UTR3 | 1987 | Dengue virus 2 isolate DENV-2/US/BID-V1170/1987, complete genome |
| ACA48842 | 3391 | 2 | USA | UTR5CMENS1NS2ANS2BNS3NS4A2KNS4BNS5UTR3 | 1987 | Dengue virus 2 isolate DENV-2/US/BID-V1171/1987, complete genome |
| ACA48843 | 3391 | 2 | USA | UTR5CMENS1NS2ANS2BNS3NS4A2KNS4BNS5UTR3 | 1987 | Dengue virus 2 isolate DENV-2/US/BID-V1172/1987, complete genome |
| ACA48844 | 3391 | 2 | USA | UTR5CMENS1NS2ANS2BNS3NS4A2KNS4BNS5UTR3 | 1987 | Dengue virus 2 isolate DENV-2/US/BID-V1174/1987, complete genome |
| ACA48845 | 3391 | 2 | USA | UTR5CMENS1NS2ANS2BNS3NS4A2KNS4BNS5UTR3 | 1988 | Dengue virus 2 isolate DENV-2/US/BID-V1175/1988, complete genome |
| ACA48846 | 3391 | 2 | USA | UTR5CMENS1NS2ANS2BNS3NS4A2KNS4BNS5UTR3 | 1988 | Dengue virus 2 isolate DENV-2/US/BID-V1176/1988, complete genome |
| ACA48847 | 3391 | 2 | USA | UTR5CMENS1NS2ANS2BNS3NS4A2KNS4BNS5UTR3 | 1989 | Dengue virus 2 isolate DENV-2/US/BID-V1177/1989, complete genome |
| ACA48848 | 3391 | 2 | USA | UTR5CMENS1NS2ANS2BNS3NS4A2KNS4BNS5UTR3 | 1989 | Dengue virus 2 isolate DENV-2/US/BID-V1178/1989, complete genome |
| ACA48849 | 3391 | 2 | USA | UTR5CMENS1NS2ANS2BNS3NS4A2KNS4BNS5UTR3 | 1989 | Dengue virus 2 isolate DENV-2/US/BID-V1179/1989, complete genome |
| ACA48850 | 3391 | 2 | USA | UTR5CMENS1NS2ANS2BNS3NS4A2KNS4BNS5UTR3 | 1989 | Dengue virus 2 isolate DENV-2/US/BID-V1180/1989, complete genome |
| ACA48851 | 3391 | 2 | USA | UTR5CMENS1NS2ANS2BNS3NS4A2KNS4BNS5UTR3 | 1989 | Dengue virus 2 isolate DENV-2/US/BID-V1181/1989, complete genome |
| ACA48852 | 3391 | 2 | USA | UTR5CMENS1NS2ANS2BNS3NS4A2KNS4BNS5UTR3 | 1989 | Dengue virus 2 isolate DENV-2/US/BID-V1182/1989, complete genome |
| ACA48853 | 3391 | 2 | USA | UTR5CMENS1NS2ANS2BNS3NS4A2KNS4BNS5UTR3 | 1990 | Dengue virus 2 isolate DENV-2/US/BID-V1183/1990, complete genome |
| ACA48854 | 3391 | 2 | USA | UTR5CMENS1NS2ANS2BNS3NS4A2KNS4BNS5UTR3 | 1990 | Dengue virus 2 isolate DENV-2/US/BID-V1188/1990, complete genome |
| ACA48855 | 3391 | 2 | USA | UTR5CMENS1NS2ANS2BNS3NS4A2KNS4BNS5UTR3 | 1990 | Dengue virus 2 isolate DENV-2/US/BID-V1189/1990, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACB29513 | 3391 | 2 | USA | UTR5CMENS1NS2ANS2BNS3NS4A2KNS4BNS5UTR3 | 1993 | Dengue virus 2 isolate DENV-2/US/BID-V1356/1993, complete genome |
| ACA48856 | 3391 | 2 | USA | UTR5CMENS1NS2ANS2BNS3NS4A2KNS4BNS5UTR3 | 1993 | Dengue virus 2 isolate DENV-2/US/BID-V1360/1993, complete genome |
| ACB29514 | 3391 | 2 | USA | UTR5CMENS1NS2ANS2BNS3NS4A2KNS4BNS5UTR3 | 1995 | Dengue virus 2 isolate DENV-2/US/BID-V1367/1995, complete genome |
| ACB29515 | 3391 | 2 | USA | UTR5CMENS1NS2ANS2BNS3NS4A2KNS4BNS5UTR3 | 1995 | Dengue virus 2 isolate DENV-2/US/BID-V1368/1995, complete genome |
| ACD13310 | 3391 | 2 | USA | UTR5CMENS1NS2ANS2BNS3NS4A2KNS4BNS5UTR3 | 1995 | Dengue virus 2 isolate DENV-2/US/BID-V1372/1995, complete genome |
| ACB29516 | 3391 | 2 | USA | UTR5CMENS1NS2ANS2BNS3NS4A2KNS4BNS5UTR3 | 1995 | Dengue virus 2 isolate DENV-2/US/BID-V1373/1995, complete genome |
| ACB29517 | 3391 | 2 | USA | UTR5CMENS1NS2ANS2BNS3NS4A2KNS4BNS5UTR3 | 1996 | Dengue virus 2 isolate DENV-2/US/BID-V1376/1996, complete genome |
| ACB87126 | 3391 | 2 | USA | UTR5CMENS1NS2ANS2BNS3NS4A2KNS4BNS5UTR3 | 1996 | Dengue virus 2 isolate DENV-2/US/BID-V1378/1996, complete genome |
| ACB29518 | 3391 | 2 | USA | UTR5CMENS1NS2ANS2BNS3NS4A2KNS4BNS5UTR3 | 1996 | Dengue virus 2 isolate DENV-2/US/BID-V1383/1996, complete genome |
| ACB87127 | 3391 | 2 | USA | UTR5CMENS1NS2ANS2BNS3NS4A2KNS4BNS5UTR3 | 1996 | Dengue virus 2 isolate DENV-2/US/BID-V1385/1996, complete genome |
| ACD13396 | 3391 | 2 | USA | UTR5CMENS1NS2ANS2BNS3NS4A2KNS4BNS5UTR3 | 1998 | Dengue virus 2 isolate DENV-2/US/BID-V1387/1998, complete genome |
| ACD13311 | 3391 | 2 | USA | UTR5CMENS1NS2ANS2BNS3NS4A2KNS4BNS5UTR3 | 1998 | Dengue virus 2 isolate DENV-2/US/BID-V1388/1998, complete genome |
| ACB29519 | 3391 | 2 | USA | UTR5CMENS1NS2ANS2BNS3NS4A2KNS4BNS5UTR3 | 1998 | Dengue virus 2 isolate DENV-2/US/BID-V1392/1998, complete genome |
| ACB29520 | 3391 | 2 | USA | UTR5CMENS1NS2ANS2BNS3NS4A2KNS4BNS5UTR3 | 1998 | Dengue virus 2 isolate DENV-2/US/BID-V1393/1998, complete genome |
| ACB87128 | 3391 | 2 | USA | UTR5CMENS1NS2ANS2BNS3NS4A2KNS4BNS5UTR3 | 1998 | Dengue virus 2 isolate DENV-2/US/BID-V1394/1998, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACB29521 | 3391 | 2 | USA | UTR5CMENS1NS2ANS2BNS3NS4A2KNS4BNS5UTR3 | 1997 | Dengue virus 2 isolate DENV-2/US/BID-V1395/1997, complete genome |
| ACB29522 | 3391 | 2 | USA | UTR5CMENS1NS2ANS2BNS3NS4A2KNS4BNS5UTR3 | 1997 | Dengue virus 2 isolate DENV-2/US/BID-V1396/1997, complete genome |
| ACB29523 | 3391 | 2 | USA | UTR5CMENS1NS2ANS2BNS3NS4A2KNS4BNS5UTR3 | 1997 | Dengue virus 2 isolate DENV-2/US/BID-V1397/1997, complete genome |
| ACB29524 | 3391 | 2 | USA | UTR5CMENS1NS2ANS2BNS3NS4A2KNS4BNS5UTR3 | 1997 | Dengue virus 2 isolate DENV-2/US/BID-V1398/1997, complete genome |
| ACB29525 | 3391 | 2 | USA | UTR5CMENS1NS2ANS2BNS3NS4A2KNS4BNS5UTR3 | 1997 | Dengue virus 2 isolate DENV-2/US/BID-V1399/1997, complete genome |
| ACB29526 | 3391 | 2 | USA | UTR5CMENS1NS2ANS2BNS3NS4A2KNS4BNS5UTR3 | 1997 | Dengue virus 2 isolate DENV-2/US/BID-V1401/1997, complete genome |
| ACB29527 | 3391 | 2 | USA | UTR5CMENS1NS2ANS2BNS3NS4A2KNS4BNS5UTR3 | 1997 | Dengue virus 2 isolate DENV-2/US/BID-V1404/1997, complete genome |
| ACB29528 | 3391 | 2 | USA | UTR5CMENS1NS2ANS2BNS3NS4A2KNS4BNS5UTR3 | 1997 | Dengue virus 2 isolate DENV-2/US/BID-V1409/1997, complete genome |
| ACB87129 | 3391 | 2 | USA | UTR5CMENS1NS2ANS2BNS3NS4A2KNS4BNS5UTR3 | 2007 | Dengue virus 2 isolate DENV-2/US/BID-V1410/2007, complete genome |
| ACB87130 | 3391 | 2 | USA | UTR5CMENS1NS2ANS2BNS3NS4A2KNS4BNS5UTR3 | 2007 | Dengue virus 2 isolate DENV-2/US/BID-V1411/2007, complete genome |
| ACB87131 | 3391 | 2 | USA | UTR5CMENS1NS2ANS2BNS3NS4A2KNS4BNS5UTR3 | 2007 | Dengue virus 2 isolate DENV-2/US/BID-V1412/2007, complete genome |
| ACB87132 | 3391 | 2 | USA | UTR5CMENS1NS2ANS2BNS3NS4A2KNS4BNS5UTR3 | 2007 | Dengue virus 2 isolate DENV-2/US/BID-V1413/2007, complete genome |
| ACD13348 | 3391 | 2 | USA | UTR5CMENS1NS2ANS2BNS3NS4A2KNS4BNS5UTR3 | 1996 | Dengue virus 2 isolate DENV-2/US/BID-V1424/1996, complete genome |
| ACD13349 | 3391 | 2 | USA | UTR5CMENS1NS2ANS2BNS3NS4A2KNS4BNS5UTR3 | 1999 | Dengue virus 2 isolate DENV-2/US/BID-V1425/1999, complete genome |
| ACD13350 | 3391 | 2 | USA | UTR5CMENS1NS2ANS2BNS3NS4A2KNS4BNS5UTR3 | 1999 | Dengue virus 2 isolate DENV-2/US/BID-V1426/1999, complete genome |

TABLE 35-continued

| Full-length Dengue Amino Acid Sequences (*Homo sapiens* strains; Brazil, Cuba and U.S.) | | | | | | |
|---|---|---|---|---|---|---|
| GenBank Accession | Length | Type | Country | Genome Region | Collection Date | Virus Name |
| ACD13351 | 3391 | 2 | USA | UTR5CMENS1NS 2ANS2BNS3NS4 A2KNS4BNS5UT R3 | 1999 | Dengue virus 2 isolate DENV-2/US/BID-V1427/1999, complete genome |
| ACD13352 | 3391 | 2 | USA | UTR5CMENS1NS 2ANS2BNS3NS4 A2KNS4BNS5UT R3 | 1999 | Dengue virus 2 isolate DENV-2/US/BID-V1428/1999, complete genome |
| ACD13353 | 3391 | 2 | USA | UTR5CMENS1NS 2ANS2BNS3NS4 A2KNS4BNS5UT R3 | 2004 | Dengue virus 2 isolate DENV-2/US/B ID-V1431/2004, complete genome |
| ACD13354 | 3391 | 2 | USA | UTR5CMENS1NS 2ANS2BNS3NS4 A2KNS4BNS5UT R3 | 2004 | Dengue virus 2 isolate DENV-2/US/BID-V1432/2004, complete genome |
| ACD13397 | 3391 | 2 | USA | UTR5CMENS1NS 2ANS2BNS3NS4 A2KNS4BNS5UT R3 | 2004 | Dengue virus 2 isolate DENV-2/US/BID-V1434/2004, complete genome |
| ACD13398 | 3391 | 2 | USA | UTR5CMENS1NS 2ANS2BNS3NS4 A2KNS4BNS5UT R3 | 2004 | Dengue virus 2 isolate DENV-2/US/BID-V1435/2004, complete genome |
| ACD13399 | 3391 | 2 | USA | UTR5CMENS1NS 2ANS2BNS3NS4 A2KNS4BNS5UT R3 | 2004 | Dengue virus 2 isolate DENV-2/US/BID-V1436/2004, complete genome |
| ACD13400 | 3391 | 2 | USA | UTR5CMENS1NS 2ANS2BNS3NS4 A2KNS4BNS5UT R3 | 2005 | Dengue virus 2 isolate DENV-2/US/BID-V1439/2005, complete genome |
| ACE63530 | 3391 | 2 | USA | UTR5CMENS1NS 2ANS2BNS3NS4 A2KNS4BNS5UT R3 | 2005 | Dengue virus 2 isolate DENV-2/US/BID-V1440/2005, complete genome |
| ACD13401 | 3391 | 2 | USA | UTR5CMENS1NS 2ANS2BNS3NS4 A2KNS4BNS5UT R3 | 2005 | Dengue virus 2 isolate DENV-2/US/BID-V1441/2005, complete genome |
| ACE63543 | 3391 | 2 | USA | UTR5CMENS1NS 2ANS2BNS3NS4 A2KNS4BNS5UT R3 | 2005 | Dengue virus 2 isolate DENV-2/US/BID-V1442/2005, complete genome |
| ACD13406 | 3391 | 2 | USA | UTR5CMENS1NS 2ANS2BNS3NS4 A2KNS4BNS5UT R3 | 2000 | Dengue virus 2 isolate DENV-2/US/BID-V1461/2000, complete genome |
| ACD13407 | 3391 | 2 | USA | UTR5CMENS1NS 2ANS2BNS3NS4 A2KNS4BNS5UT R3 | 2000 | Dengue virus 2 isolate DENV-2/US/BID-V1462/2000, complete genome |
| ACD13408 | 3391 | 2 | USA | UTR5CMENS1NS 2ANS2BNS3NS4 A2KNS4BNS5UT R3 | 2000 | Dengue virus 2 isolate DENV-2/US/BID-V1463/2000, complete genome |
| ACD13409 | 3391 | 2 | USA | UTR5CMENS1NS 2ANS2BNS3NS4 A2KNS4BNS5UT R3 | 2000 | Dengue virus 2 isolate DENV-2/US/BID-V1464/2000, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACD13411 | 3391 | 2 | USA | UTR5CMENS1NS2ANS2BNS3NS4A2KNS4BNS5UTR3 | 2001 | Dengue virus 2 isolate DENV-2/US/BID-V1467/2001, complete genome |
| ACD13412 | 3391 | 2 | USA | UTR5CMENS1NS2ANS2BNS3NS4A2KNS4BNS5UTR3 | 2001 | Dengue virus 2 isolate DENV-2/US/BID-V1468/2001, complete genome |
| ACD13413 | 3391 | 2 | USA | UTR5CMENS1NS2ANS2BNS3NS4A2KNS4BNS5UTR3 | 2001 | Dengue virus 2 isolate DENV-2/US/BID-V1469/2001, complete genome |
| ACD13414 | 3391 | 2 | USA | UTR5CMENS1NS2ANS2BNS3NS4A2KNS4BNS5UTR3 | 2001 | Dengue virus 2 isolate DENV-2/US/BID-V1470/2001, complete genome |
| ACD13415 | 3391 | 2 | USA | UTR5CMENS1NS2ANS2BNS3NS4A2KNS4BNS5UTR3 | 2001 | Dengue virus 2 isolate DENV-2/US/BID-V1471/2001, complete genome |
| ACD13416 | 3391 | 2 | USA | UTR5CMENS1NS2ANS2BNS3NS4A2KNS4BNS5UTR3 | 2001 | Dengue virus 2 isolate DENV-2/US/BID-V1472/2001, complete genome |
| ACD13395 | 3391 | 2 | USA | UTR5CMENS1NS2ANS2BNS3NS4A2KNS4BNS5UTR3 | 2003 | Dengue virus 2 isolate DENV-2/US/BID-V1482/2003, complete genome |
| ACD13419 | 3391 | 2 | USA | UTR5CMENS1NS2ANS2BNS3NS4A2KNS4BNS5UTR3 | 2003 | Dengue virus 2 isolate DENV-2/US/BID-V1483/2003, complete genome |
| ACD13420 | 3391 | 2 | USA | UTR5CMENS1NS2ANS2BNS3NS4A2KNS4BNS5UTR3 | 2003 | Dengue virus 2 isolate DENV-2/US/BID-V1484/2003, complete genome |
| ACD13421 | 3391 | 2 | USA | UTR5CMENS1NS2ANS2BNS3NS4A2KNS4BNS5UTR3 | 2003 | Dengue virus 2 isolate DENV-2/US/BID-V1486/2003, complete genome |
| ACD13422 | 3391 | 2 | USA | UTR5CMENS1NS2ANS2BNS3NS4A2KNS4BNS5UTR3 | 2003 | Dengue virus 2 isolate DENV-2/US/BID-V1487/2003, complete genome |
| ACD13424 | 3391 | 2 | USA | UTR5CMENS1NS2ANS2BNS3NS4A2KNS4BNS5UTR3 | 2003 | Dengue virus 2 isolate DENV-2/US/BID-V1492/2003, complete genome |
| ACD13425 | 3391 | 2 | USA | UTR5CMENS1NS2ANS2BNS3NS4A2KNS4BNS5UTR3 | 2003 | Dengue virus 2 isolate DENV-2/US/BID-V1493/2003, complete genome |
| ACD13426 | 3391 | 2 | USA | UTR5CMENS1NS2ANS2BNS3NS4A2KNS4BNS5UTR3 | 2004 | Dengue virus 2 isolate DENV-2/US/BID-V1494/2004, complete genome |
| ACD13427 | 3391 | 2 | USA | UTR5CMENS1NS2ANS2BNS3NS4A2KNS4BNS5UTR3 | 2004 | Dengue virus 2 isolate DENV-2/US/BID-V1495/2004, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACD13428 | 3391 | 2 | USA | UTR5CMENS1NS2ANS2BNS3NS4A2KNS4BNS5UTR3 | 2004 | Dengue virus 2 isolate DENV-2/US/BID-V1496/2004, complete genome |
| ACD13429 | 3391 | 2 | USA | UTR5CMENS1NS2ANS2BNS3NS4A2KNS4BNS5UTR3 | 2005 | Dengue virus 2 isolate DENV-2/US/BID-V1497/2005, complete genome |
| AEH59341 | 3390 | 2 | USA | CMENS1NS2ANS2BNS3NS4A2KNS4BNS5 | 2009 | Dengue virus 2 isolate DENV-2/US/BID-V4824/2009, complete genome |
| AEH59346 | 3391 | 2 | USA | UTR5CMENS1NS2ANS2BNS3NS4A2KNS4BNS5 | 2006 | Dengue virus 2 isolate DENV-2/US/BID-V5411/2006, complete genome |
| AEH59345 | 3391 | 2 | USA | UTR5CMENS1NS2ANS2BNS3NS4A2KNS4BNS5 | 2007 | Dengue virus 2 isolate DENV-2/US/BID-V5412/2007, complete genome |
| ACA58343 | 3391 | 2 | USA | UTR5CMENS1NS2ANS2BNS3NS4A2KNS4BNS5UTR3 | 2006 | Dengue virus 2 isolate DENV-2/US/BID-V585/2006, complete genome |
| ACA48986 | 3391 | 2 | USA | UTR5CMENS1NS2ANS2BNS3NS4A2KNS4BNS5UTR3 | 2006 | Dengue virus 2 isolate DENV-2/US/BID-V587/2006, complete genome |
| ACA48987 | 3391 | 2 | USA | UTR5CMENS1NS2ANS2BNS3NS4A2KNS4BNS5UTR3 | 2006 | Dengue virus 2 isolate DENV-2/US/BID-V588/2006, complete genome |
| ACA48988 | 3391 | 2 | USA | UTR5CMENS1NS2ANS2BNS3NS4A2KNS4BNS5UTR3 | 2006 | Dengue virus 2 isolate DENV-2/US/BID-V589/2006, complete genome |
| ACA48989 | 3391 | 2 | USA | UTR5CMENS1NS2ANS2BNS3NS4A2KNS4BNS5UTR3 | 2002 | Dengue virus 2 isolate DENV-2/US/BID-V591/2002, complete genome |
| ACA48990 | 3391 | 2 | USA | UTR5CMENS1NS2ANS2BNS3NS4A2KNS4BNS5UTR3 | 2002 | Dengue virus 2 isolate DENV-2/US/BID-V592/2002, complete genome |
| ACA48991 | 3391 | 2 | USA | UTR5CMENS1NS2ANS2BNS3NS4A2KNS4BNS5UTR3 | 2005 | Dengue virus 2 isolate DENV-2/US/BID-V593/2005, complete genome |
| ACA48992 | 3391 | 2 | USA | UTR5CMENS1NS2ANS2BNS3NS4A2KNS4BNS5UTR3 | 2006 | Dengue virus 2 isolate DENV-2/US/BID-V594/2006, complete genome |
| ACA48993 | 3391 | 2 | USA | UTR5CMENS1NS2ANS2BNS3NS4A2KNS4BNS5UTR3 | 2006 | Dengue virus 2 isolate DENV-2/US/BID-V595/2006, complete genome |
| ACA48994 | 3391 | 2 | USA | UTR5CMENS1NS2ANS2BNS3NS4A2KNS4BNS5UTR3 | 1998 | Dengue virus 2 isolate DENV-2/US/BID-V596/1998, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACA48995 | 3391 | 2 | USA | UTR5CMENS1NS2ANS2BNS3NS4A2KNS4BNS5UTR3 | 1998 | Dengue virus 2 isolate DENV-2/US/BID-V597/1998, complete genome |
| ACA48996 | 3391 | 2 | USA | UTR5CMENS1NS2ANS2BNS3NS4A2KNS4BNS5UTR3 | 1999 | Dengue virus 2 isolate DENV-2/US/BID-V598/1999, complete genome |
| ACA48997 | 3391 | 2 | USA | UTR5CMENS1NS2ANS2BNS3NS4A2KNS4BNS5UTR3 | 1999 | Dengue virus 2 isolate DENV-2/US/BID-V599/1999, complete genome |
| ACA48998 | 3391 | 2 | USA | UTR5CMENS1NS2ANS2BNS3NS4A2KNS4BNS5UTR3 | 2005 | Dengue virus 2 isolate DENV-2/US/BID-V600/2005, complete genome |
| ACA48999 | 3391 | 2 | USA | UTR5CMENS1NS2ANS2BNS3NS4A2KNS4BNS5UTR3 | 1998 | Dengue virus 2 isolate DENV-2/US/BID-V675/1998, complete genome |
| ACA49000 | 3391 | 2 | USA | UTR5CMENS1NS2ANS2BNS3NS4A2KNS4BNS5UTR3 | 1998 | Dengue virus 2 isolate DENV-2/US/BID-V676/1998, complete genome |
| ACA49001 | 3391 | 2 | USA | UTR5CMENS1NS2ANS2BNS3NS4A2KNS4BNS5UTR3 | 1998 | Dengue virus 2 isolate DENV-2/US/BID-V677/1998, complete genome |
| ACA49002 | 3391 | 2 | USA | UTR5CMENS1NS2ANS2BNS3NS4A2KNS4BNS5UTR3 | 1998 | Dengue virus 2 isolate DENV-2/US/BID-V678/1998, complete genome |
| ACA49003 | 3391 | 2 | USA | UTR5CMENS1NS2ANS2BNS3NS4A2KNS4BNS5UTR3 | 1994 | Dengue virus 2 isolate DENV-2/US/BID-V679/1994, complete genome |
| ACA49004 | 3391 | 2 | USA | UTR5CMENS1NS2ANS2BNS3NS4A2KNS4BNS5UTR3 | 1994 | Dengue virus 2 isolate DENV-2/US/BID-V680/1994, complete genome |
| ACA49005 | 3391 | 2 | USA | UTR5CMENS1NS2ANS2BNS3NS4A2KNS4BNS5UTR3 | 1998 | Dengue virus 2 isolate DENV-2/US/BID-V681/1998, complete genome |
| ACA49006 | 3391 | 2 | USA | UTR5CMENS1NS2ANS2BNS3NS4A2KNS4BNS5UTR3 | 1994 | Dengue virus 2 isolate DENV-2/US/BID-V682/1994, complete genome |
| ACA49007 | 3391 | 2 | USA | UTR5CMENS1NS2ANS2BNS3NS4A2KNS4BNS5UTR3 | 1994 | Dengue virus 2 isolate DENV-2/US/BID-V683/1994, complete genome |
| ACA49008 | 3391 | 2 | USA | UTR5CMENS1NS2ANS2BNS3NS4A2KNS4BNS5UTR3 | 1994 | Dengue virus 2 isolate DENV-2/US/BID-V684/1994, complete genome |
| ACA49009 | 3391 | 2 | USA | UTR5CMENS1NS2ANS2BNS3NS4A2KNS4BNS5UTR3 | 1988 | Dengue virus 2 isolate DENV-2/US/BID-V685/1988, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACA49010 | 3391 | 2 | USA | UTR5CMENS1NS2ANS2BNS3NS4A2KNS4BNS5UTR3 | 1989 | Dengue virus 2 isolate DENV-2/US/BID-V686/1989, complete genome |
| ACA49011 | 3391 | 2 | USA | UTR5CMENS1NS2ANS2BNS3NS4A2KNS4BNS5UTR3 | 1989 | Dengue virus 2 isolate DENV-2/US/BID-V687/1989, complete genome |
| ACA49012 | 3391 | 2 | USA | UTR5CMENS1NS2ANS2BNS3NS4A2KNS4BNS5UTR3 | 1989 | Dengue virus 2 isolate DENV-2/US/BID-V688/1989, complete genome |
| ACA49013 | 3391 | 2 | USA | UTR5CMENS1NS2ANS2BNS3NS4A2KNS4BNS5UTR3 | 1989 | Dengue virus 2 isolate DENV-2/US/BID-V689/1989, complete genome |
| ACA49014 | 3391 | 2 | USA | UTR5CMENS1NS2ANS2BNS3NS4A2KNS4BNS5UTR3 | 1988 | Dengue virus 2 isolate DENV-2/US/BID-V690/1988, complete genome |
| ACA48857 | 3391 | 2 | USA | UTR5CMENS1NS2ANS2BNS3NS4A2KNS4BNS5UTR3 | 1990 | Dengue virus 2 isolate DENV-2/US/BID-V851/1990, complete genome |
| ACA48860 | 3391 | 2 | USA | UTR5CMENS1NS2ANS2BNS3NS4A2KNS4BNS5UTR3 | 2001 | Dengue virus 2 isolate DENV-2/US/BID-V854/2001, complete genome |
| ACA48861 | 3391 | 2 | USA | UTR5CMENS1NS2ANS2BNS3NS4A2KNS4BNS5UTR3 | 1992 | Dengue virus 2 isolate DENV-2/US/BID-V855/1992, complete genome |
| ACA48822 | 3390 | 3 | USA | UTR5CMENS1NS2ANS2BNS3NS4A2KNS4BNS5UTR3 | 2006 | Dengue virus 3 isolate DENV-3/US/BID-V1043/2006, complete genome |
| ACA58329 | 3390 | 3 | USA | UTR5CMENS1NS2ANS2BNS3NS4A2KNS4BNS5UTR3 | 2006 | Dengue virus 3 isolate DENV-3/US/BID-V1044/2006, complete genome |
| ACA48825 | 3390 | 3 | USA | UTR5CMENS1NS2ANS2BNS3NS4A2KNS4BNS5UTR3 | 1998 | Dengue virus 3 isolate DENV-3/US/BID-V1049/1998, complete genome |
| ACA48826 | 3390 | 3 | USA | UTR5CMENS1NS2ANS2BNS3NS4A2KNS4BNS5UTR3 | 1998 | Dengue virus 3 isolate DENV-3/US/BID-V1050/1998, complete genome |
| ACA48830 | 3390 | 3 | USA | UTR5CMENS1NS2ANS2BNS3NS4A2KNS4BNS5UTR3 | 1998 | Dengue virus 3 isolate DENV-3/US/BID-V1075/1998, complete genome |
| ACA58333 | 3390 | 3 | USA | UTR5CMENS1NS2ANS2BNS3NS4A2KNS4BNS5UTR3 | 1999 | Dengue virus 3 isolate DENV-3/US/BID-V1076/1999, complete genome |
| ACA58334 | 3390 | 3 | USA | UTR5CMENS1NS2ANS2BNS3NS4A2KNS4BNS5UTR3 | 2000 | Dengue virus 3 isolate DENV-3/US/BID-V1077/2000, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACA48831 | 3390 | 3 | USA | UTR5CMENS1NS2ANS2BNS3NS4A2KNS4BNS5UTR3 | 2003 | Dengue virus 3 isolate DENV-3/US/BID-V1078/2003, complete genome |
| ACA58335 | 3390 | 3 | USA | UTR5CMENS1NS2ANS2BNS3NS4A2KNS4BNS5UTR3 | 2006 | Dengue virus 3 isolate DENV-3/US/BID-V1079/2006, complete genome |
| ACA58336 | 3390 | 3 | USA | UTR5CMENS1NS2ANS2BNS3NS4A2KNS4BNS5UTR3 | 2006 | Dengue virus 3 isolate DENV-3/US/BID-V1080/2006, complete genome |
| ACA48833 | 3390 | 3 | USA | UTR5CMENS1NS2ANS2BNS3NS4A2KNS4BNS5UTR3 | 1998 | Dengue virus 3 isolate DENV-3/US/BID-V1088/1998, complete genome |
| ACA58339 | 3390 | 3 | USA | UTR5CMENS1NS2ANS2BNS3NS4A2KNS4BNS5UTR3 | 2003 | Dengue virus 3 isolate DENV-3/US/BID-V1089/2003, complete genome |
| ACA58340 | 3390 | 3 | USA | UTR5CMENS1NS2ANS2BNS3NS4A2KNS4BNS5UTR3 | 1998 | Dengue virus 3 isolate DENV-3/US/BID-V1090/1998, complete genome |
| ACA58341 | 3390 | 3 | USA | UTR5CMENS1NS2ANS2BNS3NS4A2KNS4BNS5UTR3 | 2004 | Dengue virus 3 isolate DENV-3/US/BID-V1091/2004, complete genome |
| ACA58342 | 3390 | 3 | USA | UTR5CMENS1NS2ANS2BNS3NS4A2KNS4BNS5UTR3 | 2004 | Dengue virus 3 isolate DENV-3/US/BID-V1092/2004, complete genome |
| ACB87133 | 3390 | 3 | USA | UTR5CMENS1NS2ANS2BNS3NS4A2KNS4BNS5UTR3 | 2007 | Dengue virus 3 isolate DENV-3/US/BID-V1415/2007, complete genome |
| ACB87134 | 3390 | 3 | USA | UTR5CMENS1NS2ANS2BNS3NS4A2KNS4BNS5UTR3 | 2007 | Dengue virus 3 isolate DENV-3/US/BID-V1416/2007, complete genome |
| ACB87135 | 3390 | 3 | USA | UTR5CMENS1NS2ANS2BNS3NS4A2KNS4BNS5UTR3 | 2007 | Dengue virus 3 isolate DENV-3/US/BID-V1417/2007, complete genome |
| ACD13402 | 3390 | 3 | USA | UTR5CMENS1NS2ANS2BNS3NS4A2KNS4BNS5UTR3 | 1998 | Dengue virus 3 isolate DENV-3/US/BID-V1447/1998, complete genome |
| ACE63531 | 3390 | 3 | USA | UTR5CMENS1NS2ANS2BNS3NS4A2KNS4BNS5UTR3 | 1998 | Dengue virus 3 isolate DENV-3/US/BID-V1448/1998, complete genome |
| ACE63532 | 3390 | 3 | USA | UTR5CMENS1NS2ANS2BNS3NS4A2KNS4BNS5UTR3 | 1998 | Dengue virus 3 isolate DENV-3/US/BID-V1449/1998, complete genome |
| ACH99660 | 3390 | 3 | USA | UTR5CMENS1NS2ANS2BNS3NS4A2KNS4BNS5UTR3 | 1998 | Dengue virus 3 isolate DENV-3/US/BID-V1450/1998, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACE63544 | 3390 | 3 | USA | UTR5CMENS1NS2ANS2BNS3NS4A2KNS4BNS5UTR3 | 1999 | Dengue virus 3 isolate DENV-3/US/BID-V1451/1999, complete genome |
| ACE63545 | 3390 | 3 | USA | UTR5CMENS1NS2ANS2BNS3NS4A2KNS4BNS5UTR3 | 1999 | Dengue virus 3 isolate DENV-3/US/BID-V1452/1999, complete genome |
| ACE63533 | 3390 | 3 | USA | UTR5CMENS1NS2ANS2BNS3NS4A2KNS4BNS5UTR3 | 1999 | Dengue virus 3 isolate DENV-3/US/BID-V1453/1999, complete genome |
| ACE63534 | 3390 | 3 | USA | UTR5CMENS1NS2ANS2BNS3NS4A2KNS4BNS5UTR3 | 1999 | Dengue virus 3 isolate DENV-3/US/BID-V1454/1999, complete genome |
| ACD13403 | 3390 | 3 | USA | UTR5CMENS1NS2ANS2BNS3NS4A2KNS4BNS5UTR3 | 1999 | Dengue virus 3 isolate DENV-3/US/BID-V1455/1999, complete genome |
| ACD13405 | 3390 | 3 | USA | UTR5CMENS1NS2ANS2BNS3NS4A2KNS4BNS5UTR3 | 2000 | Dengue virus 3 isolate DENV-3/US/BID-V1460/2000, complete genome |
| ACE63528 | 3390 | 3 | USA | UTR5CMENS1NS2ANS2BNS3NS4A2KNS4BNS5UTR3 | 2000 | Dengue virus 3 isolate DENV-3/US/BID-V1465/2000, complete genome |
| ACD13410 | 3390 | 3 | USA | UTR5CMENS1NS2ANS2BNS3NS4A2KNS4BNS5UTR3 | 1999 | Dengue virus 3 isolate DENV-3/US/BID-V1466/1999, complete genome |
| ACD13417 | 3391 | 3 | USA | UTR5CMENS1NS2ANS2BNS3NS4A2KNS4BNS5UTR3 | 2002 | Dengue virus 3 isolate DENV-3/US/BID-V1473/2002, complete genome |
| ACD13418 | 3390 | 3 | USA | UTR5CMENS1NS2ANS2BNS3NS4A2KNS4BNS5UTR3 | 2002 | Dengue virus 3 isolate DENV-3/US/BID-V1475/2002, complete genome |
| ACD13392 | 3390 | 3 | USA | UTR5CMENS1NS2ANS2BNS3NS4A2KNS4BNS5UTR3 | 2002 | Dengue virus 3 isolate DENV-3/US/BID-V1476/2002, complete genome |
| ACH61690 | 3390 | 3 | USA | UTR5CMENS1NS2ANS2BNS3NS4A2KNS4BNS5UTR3 | 2002 | Dengue virus 3 isolate DENV-3/US/BID-V1477/2002, complete genome |
| ACJ04182 | 3390 | 3 | USA | UTR5CMENS1NS2ANS2BNS3NS4A2KNS4BNS5UTR3 | 2002 | Dengue virus 3 isolate DENV-3/US/BID-V1478/2002, complete genome |
| ACD13393 | 3390 | 3 | USA | UTR5CMENS1NS2ANS2BNS3NS4A2KNS4BNS5UTR3 | 2003 | Dengue virus 3 isolate DENV-3/US/BID-V1480/2003, complete genome |
| ACD13394 | 3390 | 3 | USA | UTR5CMENS1NS2ANS2BNS3NS4A2KNS4BNS5UTR3 | 2003 | Dengue virus 3 isolate DENV-3/US/BID-V1481/2003, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACE63529 | 3390 | 3 | USA | UTR5CMENS1NS2ANS2BNS3NS4A2KNS4BNS5UTR3 | 2003 | Dengue virus 3 isolate DENV-3/US/BID-V1490/2003, complete genome |
| ACD13423 | 3390 | 3 | USA | UTR5CMENS1NS2ANS2BNS3NS4A2KNS4BNS5UTR3 | 2003 | Dengue virus 3 isolate DENV-3/US/BID-V1491/2003, complete genome |
| ACH99651 | 3390 | 3 | USA | UTR5CMENS1NS2ANS2BNS3NS4A2KNS4BNS5UTR3 | 2004 | Dengue virus 3 isolate DENV-3/US/BID-V1604/2004, complete genome |
| ACO06143 | 3390 | 3 | USA | UTR5CMENS1NS2ANS2BNS3NS4A2KNS4BNS5UTR3 | 2004 | Dengue virus 3 isolate DENV-3/US/BID-V1605/2004, complete genome |
| ACH61715 | 3390 | 3 | USA | UTR5CMENS1NS2ANS2BNS3NS4A2KNS4BNS5UTR3 | 2004 | Dengue virus 3 isolate DENV-3/US/BID-V1606/2004, complete genome |
| ACH61716 | 3390 | 3 | USA | UTR5CMENS1NS2ANS2BNS3NS4A2KNS4BNS5UTR3 | 2004 | Dengue virus 3 isolate DENV-3/US/BID-V1607/2004, complete genome |
| ACH61717 | 3390 | 3 | USA | UTR5CMENS1NS2ANS2BNS3NS4A2KNS4BNS5UTR3 | 2004 | Dengue virus 3 isolate DENV-3/US/BID-V1608/2004, complete genome |
| ACH61718 | 3390 | 3 | USA | UTR5CMENS1NS2ANS2BNS3NS4A2KNS4BNS5UTR3 | 2004 | Dengue virus 3 isolate DENV-3/US/BID-V1609/2004, complete genome |
| ACH61719 | 3390 | 3 | USA | UTR5CMENS1NS2ANS2BNS3NS4A2KNS4BNS5UTR3 | 2004 | Dengue virus 3 isolate DENV-3/US/BID-V1610/2004, complete genome |
| ACO06144 | 3390 | 3 | USA | UTR5CMENS1NS2ANS2BNS3NS4A2KNS4BNS5UTR3 | 2004 | Dengue virus 3 isolate DENV-3/US/BID-V1611/2004, complete genome |
| ACH61720 | 3390 | 3 | USA | UTR5CMENS1NS2ANS2BNS3NS4A2KNS4BNS5UTR3 | 2004 | Dengue virus 3 isolate DENV-3/US/BID-V1612/2004, complete genome |
| ACH61721 | 3390 | 3 | USA | UTR5CMENS1NS2ANS2BNS3NS4A2KNS4BNS5UTR3 | 2004 | Dengue virus 3 isolate DENV-3/US/BID-V1613/2004, complete genome |
| ACH99652 | 3390 | 3 | USA | UTR5CMENS1NS2ANS2BNS3NS4A2KNS4BNS5UTR3 | 2004 | Dengue virus 3 isolate DENV-3/US/BID-V1614/2004, complete genome |
| ACJ04178 | 3390 | 3 | USA | UTR5CMENS1NS2ANS2BNS3NS4A2KNS4BNS5UTR3 | 2004 | Dengue virus 3 isolate DENV-3/US/BID-V1615/2004, complete genome |
| ACH99653 | 3390 | 3 | USA | UTR5CMENS1NS2ANS2BNS3NS4A2KNS4BNS5UTR3 | 2004 | Dengue virus 3 isolate DENV-3/US/BID-V1616/2004, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACH99654 | 3390 | 3 | USA | UTR5CMENS1NS2ANS2BNS3NS4A2KNS4BNS5UTR3 | 2005 | Dengue virus 3 isolate DENV-3/US/BID-V1617/2005, complete genome |
| ACH99655 | 3390 | 3 | USA | UTR5CMENS1NS2ANS2BNS3NS4A2KNS4BNS5UTR3 | 2005 | Dengue virus 3 isolate DENV-3/US/BID-V1618/2005, complete genome |
| ACH99656 | 3390 | 3 | USA | UTR5CMENS1NS2ANS2BNS3NS4A2KNS4BNS5UTR3 | 2005 | Dengue virus 3 isolate DENV-3/US/BID-V1619/2005, complete genome |
| ACH99657 | 3390 | 3 | USA | UTR5CMENS1NS2ANS2BNS3NS4A2KNS4BNS5UTR3 | 2005 | Dengue virus 3 isolate DENV-3/US/BID-V1620/2005, complete genome |
| ACH99658 | 3390 | 3 | USA | UTR5CMENS1NS2ANS2BNS3NS4A2KNS4BNS5UTR3 | 2005 | Dengue virus 3 isolate DENV-3/US/BID-V1621/2005, complete genome |
| ACH99665 | 3390 | 3 | USA | UTR5CMENS1NS2ANS2BNS3NS4A2KNS4BNS5UTR3 | 2005 | Dengue virus 3 isolate DENV-3/US/BID-V1622/2005, complete genome |
| ACH99666 | 3390 | 3 | USA | UTR5CMENS1NS2ANS2BNS3NS4A2KNS4BNS5UTR3 | 2005 | Dengue virus 3 isolate DENV-3/US/BID-V1623/2005, complete genome |
| ACH99667 | 3390 | 3 | USA | UTR5CMENS1NS2ANS2BNS3NS4A2KNS4BNS5UTR3 | 2005 | Dengue virus 3 isolate DENV-3/US/BID-V1624/2005, complete genome |
| ACH99668 | 3390 | 3 | USA | UTR5CMENS1NS2ANS2BNS3NS4A2KNS4BNS5UTR3 | 2005 | Dengue virus 3 isolate DENV-3/US/BID-V1625/2005, complete genome |
| ACH99669 | 3390 | 3 | USA | UTR5CMENS1NS2ANS2BNS3NS4A2KNS4BNS5UTR3 | 2005 | Dengue virus 3 isolate DENV-3/US/BID-V1626/2005, complete genome |
| ACJ04183 | 3390 | 3 | USA | UTR5CMENS1NS2ANS2BNS3NS4A2KNS4BNS5UTR3 | 2003 | Dengue virus 3 isolate DENV-3/US/BID-V1729/2003, complete genome |
| ACJ04184 | 3390 | 3 | USA | UTR5CMENS1NS2ANS2BNS3NS4A2KNS4BNS5UTR3 | 2003 | Dengue virus 3 isolate DENV-3/US/BID-V1730/2003, complete genome |
| ACH99676 | 3390 | 3 | USA | UTR5CMENS1NS2ANS2BNS3NS4A2KNS4BNS5UTR3 | 2003 | Dengue virus 3 isolate DENV-3/US/BID-V1731/2003, complete genome |
| ACJ04185 | 3390 | 3 | USA | UTR5CMENS1NS2ANS2BNS3NS4A2KNS4BNS5UTR3 | 2002 | Dengue virus 3 isolate DENV-3/US/BID-V1732/2002, complete genome |
| ACH99677 | 3390 | 3 | USA | UTR5CMENS1NS2ANS2BNS3NS4A2KNS4BNS5UTR3 | 1999 | Dengue virus 3 isolate DENV-3/US/BID-V1733/1999, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACJ04187 | 3390 | 3 | USA | UTR5CMENS1NS2ANS2BNS3NS4A2KNS4BNS5UTR3 | 1999 | Dengue virus 3 isolate DENV-3/US/BID-V1735/1999, complete genome |
| ACJ04188 | 3390 | 3 | USA | UTR5CMENS1NS2ANS2BNS3NS4A2KNS4BNS5UTR3 | 1999 | Dengue virus 3 isolate DENV-3/US/BID-V1736/1999, complete genome |
| ACJ04189 | 3390 | 3 | USA | UTR5CMENS1NS2ANS2BNS3NS4A2KNS4BNS5UTR3 | 1999 | Dengue virus 3 isolate DENV-3/US/BID-V1737/1999, complete genome |
| ACL98985 | 3390 | 3 | USA | UTR5CMENS1NS2ANS2BNS3NS4A2KNS4BNS5UTR3 | 1999 | Dengue virus 3 isolate DENV-3/US/BID-V2098/1999, complete genome |
| ACL98986 | 3390 | 3 | USA | UTR5CMENS1NS2ANS2BNS3NS4A2KNS4BNS5UTR3 | 1998 | Dengue virus 3 isolate DENV-3/US/BID-V2099/1998, complete genome |
| ACL99014 | 3390 | 3 | USA | UTR5CMENS1NS2ANS2BNS3NS4A2KNS4BNS5UTR3 | 2000 | Dengue virus 3 isolate DENV-3/US/BID-V2100/2000, complete genome |
| ACL98987 | 3390 | 3 | USA | UTR5CMENS1NS2ANS2BNS3NS4A2KNS4BNS5UTR3 | 2000 | Dengue virus 3 isolate DENV-3/US/BID-V2103/2000, complete genome |
| ACJ04218 | 3390 | 3 | USA | UTR5CMENS1NS2ANS2BNS3NS4A2KNS4BNS5UTR3 | 2000 | Dengue virus 3 isolate DENV-3/US/BID-V2104/2000, complete genome |
| ACJ04219 | 3390 | 3 | USA | UTR5CMENS1NS2ANS2BNS3NS4A2KNS4BNS5UTR3 | 2000 | Dengue virus 3 isolate DENV-3/US/BID-V2105/2000, complete genome |
| ACL98988 | 3390 | 3 | USA | UTR5CMENS1NS2ANS2BNS3NS4A2KNS4BNS5UTR3 | 2000 | Dengue virus 3 isolate DENV-3/US/BID-V2106/2000, complete genome |
| ACL98989 | 3390 | 3 | USA | UTR5CMENS1NS2ANS2BNS3NS4A2KNS4BNS5UTR3 | 2000 | Dengue virus 3 isolate DENV-3/US/BID-V2107/2000, complete genome |
| ACL98990 | 3390 | 3 | USA | UTR5CMENS1NS2ANS2BNS3NS4A2KNS4BNS5UTR3 | 2000 | Dengue virus 3 isolate DENV-3/US/BID-V2108/2000, complete genome |
| ACL98991 | 3390 | 3 | USA | UTR5CMENS1NS2ANS2BNS3NS4A2KNS4BNS5UTR3 | 2000 | Dengue virus 3 isolate DENV-3/US/BID-V2110/2000, complete genome |
| ACL98992 | 3390 | 3 | USA | UTR5CMENS1NS2ANS2BNS3NS4A2KNS4BNS5UTR3 | 2000 | Dengue virus 3 isolate DENV-3/US/BID-V2111/2000, complete genome |
| ACL98993 | 3390 | 3 | USA | UTR5CMENS1NS2ANS2BNS3NS4A2KNS4BNS5UTR3 | 2000 | Dengue virus 3 isolate DENV-3/US/BID-V2112/2000, complete genome |

TABLE 35-continued

Full-length Dengue Amino Acid Sequences (*Homo sapiens* strains; Brazil, Cuba and U.S.)

| GenBank Accession | Length | Type | Country | Genome Region | Collection Date | Virus Name |
|---|---|---|---|---|---|---|
| ACL98994 | 3390 | 3 | USA | UTR5CMENS1NS2ANS2BNS3NS4A2KNS4BNS5UTR3 | 2000 | Dengue virus 3 isolate DENV-3/US/BID-V2113/2000, complete genome |
| ACL98995 | 3390 | 3 | USA | UTR5CMENS1NS2ANS2BNS3NS4A2KNS4BNS5UTR3 | 2001 | Dengue virus 3 isolate DENV-3/US/BID-V2114/2001, complete genome |
| ACL98996 | 3390 | 3 | USA | UTR5CMENS1NS2ANS2BNS3NS4A2KNS4BNS5UTR3 | 2001 | Dengue virus 3 isolate DENV-3/US/BID-V2115/2001, complete genome |
| ACL98997 | 3390 | 3 | USA | UTR5CMENS1NS2ANS2BNS3NS4A2KNS4BNS5UTR3 | 2001 | Dengue virus 3 isolate DENV-3/US/BID-V2117/2001, complete genome |
| ACL98998 | 3390 | 3 | USA | UTR5CMENS1NS2ANS2BNS3NS4A2KNS4BNS5UTR3 | 2001 | Dengue virus 3 isolate DENV-3/US/BID-V2118/2001, complete genome |
| ACL98999 | 3390 | 3 | USA | UTR5CMENS1NS2ANS2BNS3NS4A2KNS4BNS5UTR3 | 2002 | Dengue virus 3 isolate DENV-3/US/BID-V2119/2002, complete genome |
| ACJ04220 | 3390 | 3 | USA | UTR5CMENS1NS2ANS2BNS3NS4A2KNS4BNS5UTR3 | 2002 | Dengue virus 3 isolate DENV-3/US/BID-V2120/2002, complete genome |
| ACL99000 | 3390 | 3 | USA | UTR5CMENS1NS2ANS2BNS3NS4A2KNS4BNS5UTR3 | 2002 | Dengue virus 3 isolate DENV-3/US/BID-V2122/2002, complete genome |
| ACK28187 | 3390 | 3 | USA | UTR5CMENS1NS2ANS2BNS3NS4A2KNS4BNS5UTR3 | 2002 | Dengue virus 3 isolate DENV-3/US/BID-V2123/2002, complete genome |
| ACL99001 | 3390 | 3 | USA | UTR5CMENS1NS2ANS2BNS3NS4A2KNS4BNS5UTR3 | 2006 | Dengue virus 3 isolate DENV-3/US/BID-V2126/2006, complete genome |
| ACA48862 | 3390 | 3 | USA | UTR5CMENS1NS2ANS2BNS3NS4A2KNS4BNS5UTR3 | 2003 | Dengue virus 3 isolate DENV-3/US/BID-V858/2003, complete genome |
| ACA48863 | 3390 | 3 | USA | UTR5CMENS1NS2ANS2BNS3NS4A2KNS4BNS5UTR3 | 1998 | Dengue virus 3 isolate DENV-3/US/BID-V859/1998, complete genome |
| AFZ40124 | 3390 | 3 | USA | UTR5CMENS1NS2ANS2BNS3NS4A2KNS4BNS5UTR3 | 1963 | Dengue virus 3 isolate DENV-3/USA/633798/1963, complete genome |
| ACH61714 | 3387 | 4 | USA | UTR5CMENS1NS2ANS2BNS3NS4A2KNS4BNS5UTR3 | 1998 | Dengue virus 4 isolate DENV-4/US/BID-V1082/1998, complete genome |
| ACH61687 | 3387 | 4 | USA | UTR5CMENS1NS2ANS2BNS3NS4A2KNS4BNS5UTR3 | 1986 | Dengue virus 4 isolate DENV-4/US/BID-V1083/1986, complete genome |

TABLE 35-continued

| Full-length Dengue Amino Acid Sequences (*Homo sapiens* strains; Brazil, Cuba and U.S.) | | | | | | |
|---|---|---|---|---|---|---|
| GenBank Accession | Length | Type | Country | Genome Region | Collection Date | Virus Name |
| ACH61688 | 3387 | 4 | USA | UTR5CMENS1NS2ANS2BNS3NS4A2KNS4BNS5UTR3 | 1998 | Dengue virus 4 isolate DENV-4/US/BID-V1093/1998, complete genome |
| ACH61689 | 3387 | 4 | USA | UTR5CMENS1NS2ANS2BNS3NS4A2KNS4BNS5UTR3 | 1998 | Dengue virus 4 isolate DENV-4/US/BID-V1094/1998, complete genome |
| ACS32012 | 3387 | 4 | USA | UTR5CMENS1NS2ANS2BNS3NS4A2KNS4BNS5UTR3 | 1994 | Dengue virus 4 isolate DENV-4/US/BID-V2429/1994, complete genome |
| ACS32013 | 3387 | 4 | USA | UTR5CMENS1NS2ANS2BNS3NS4A2KNS4BNS5UTR3 | 1994 | Dengue virus 4 isolate DENV-4/US/BID-V2430/1994, complete genome |
| ACS32014 | 3387 | 4 | USA | UTR5CMENS1NS2ANS2BNS3NS4A2KNS4BNS5UTR3 | 1995 | Dengue virus 4 isolate DENV-4/US/BID-V2431/1995, complete genome |
| ACS32037 | 3387 | 4 | USA | UTR5CMENS1NS2ANS2BNS3NS4A2KNS4BNS5UTR3 | 1995 | Dengue virus 4 isolate DENV-4/US/BID-V2432/1995, complete genome |
| ACO06140 | 3387 | 4 | USA | UTR5CMENS1NS2ANS2BNS3NS4A2KNS4BNS5UTR3 | 1995 | Dengue virus 4 isolate DENV-4/US/BID-V2433/1995, complete genome |
| ACO06145 | 3387 | 4 | USA | UTR5CMENS1NS2ANS2BNS3NS4A2KNS4BNS5UTR3 | 1995 | Dengue virus 4 isolate DENV-4/US/BID-V2434/1995, complete genome |
| ACS32015 | 3387 | 4 | USA | UTR5CMENS1NS2ANS2BNS3NS4A2KNS4BNS5UTR3 | 1996 | Dengue virus 4 isolate DENV-4/US/BID-V2435/1996, complete genome |
| ACS32016 | 3387 | 4 | USA | UTR5CMENS1NS2ANS2BNS3NS4A2KNS4BNS5UTR3 | 1996 | Dengue virus 4 isolate DENV-4/US/BID-V2436/1996, complete genome |
| ACS32017 | 3387 | 4 | USA | UTR5CMENS1NS2ANS2BNS3NS4A2KNS4BNS5UTR3 | 1996 | Dengue virus 4 isolate DENV-4/US/BID-V2437/1996, complete genome |
| ACS32018 | 3387 | 4 | USA | UTR5CMENS1NS2ANS2BNS3NS4A2KNS4BNS5UTR3 | 1996 | Dengue virus 4 isolate DENV-4/US/BID-V2438/1996, complete genome |
| ACS32019 | 3387 | 4 | USA | UTR5CMENS1NS2ANS2BNS3NS4A2KNS4BNS5UTR3 | 1996 | Dengue virus 4 isolate DENV-4/US/BID-V2439/1996, complete genome |
| ACO06146 | 3387 | 4 | USA | UTR5CMENS1NS2ANS2BNS3NS4A2KNS4BNS5UTR3 | 1996 | Dengue virus 4 isolate DENV-4/US/BID-V2440/1996, complete genome |
| ACQ44402 | 3387 | 4 | USA | UTR5CMENS1NS2ANS2BNS3NS4A2KNS4BNS5UTR3 | 1998 | Dengue virus 4 isolate DENV-4/US/BID-V2441/1998, complete genome |

TABLE 35-continued

| Full-length Dengue Amino Acid Sequences (*Homo sapiens* strains; Brazil, Cuba and U.S.) | | | | | | |
|---|---|---|---|---|---|---|
| GenBank Accession | Length | Type | Country | Genome Region | Collection Date | Virus Name |
| ACQ44403 | 3387 | 4 | USA | UTR5CMENS1NS2ANS2BNS3NS4A2KNS4BNS5UTR3 | 1998 | Dengue virus 4 isolate DENV-4/US/BID-V2442/1998, complete genome |
| ACO06147 | 3387 | 4 | USA | UTR5CMENS1NS2ANS2BNS3NS4A2KNS4BNS5UTR3 | 1998 | Dengue virus 4 isolate DENV-4/US/BID-V2443/1998, complete genome |
| ACQ44404 | 3387 | 4 | USA | UTR5CMENS1NS2ANS2BNS3NS4A2KNS4BNS5UTR3 | 1998 | Dengue virus 4 isolate DENV-4/US/BID-V2444/1998, complete genome |
| ACQ44405 | 3387 | 4 | USA | UTR5CMENS1NS2ANS2BNS3NS4A2KNS4BNS5UTR3 | 1998 | Dengue virus 4 isolate DENV-4/US/BID-V2445/1998, complete genome |
| ACQ44406 | 3387 | 4 | USA | UTR5CMENS1NS2ANS2BNS3NS4A2KNS4BNS5UTR3 | 1999 | Dengue virus 4 isolate DENV-4/US/BID-V2446/1999, complete genome |
| ACQ44407 | 3387 | 4 | USA | UTR5CMENS1NS2ANS2BNS3NS4A2KNS4BNS5UTR3 | 1999 | Dengue virus 4 isolate DENV-4/US/BID-V2447/1999, complete genome |
| ACQ44408 | 3387 | 4 | USA | UTR5CMENS1NS2ANS2BNS3NS4A2KNS4BNS5UTR3 | 1999 | Dengue virus 4 isolate DENV-4/US/BID-V2448/1999, complete genome |
| ACJ04171 | 3387 | 4 | USA | UTR5CMENS1NS2ANS2BNS3NS4A2KNS4BNS5UTR3 | 1994 | Dengue virus 4 isolate DENV-4/US/BID-V860/1994, complete genome |

TABLE 36

| DENV POLYPEPTIDE SEQUENCES | | |
|---|---|---|
| SEQ ID NO: | Accession No. | Sequence |
| 171 | gi\|158348409\|ref\|NP_722466.2\| capsid protein [Dengue virus 1] | MNNQRKKTGRPSFNMLKRARNRVSTVSQLAKRFSKGLLSGQGPMKLVMAFIAFLRFLAIPPTAGILARWGSFKKNGAIKVLRGFKKEISNMLNIMNRRKR |
| 172 | gi\|164654862\|ref\|YP_001531164.2\| Capsid protein [Dengue virus 3] | MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINQRKK |
| 173 | gi\|159024809\|ref\|NP_739591.2\| Capsid protein [Dengue virus 2] | MNNQRKKAKNTPFNMLKRERNRVSTVQQLTKRFSLGMLQGRGPLKLFMALVAFLRFLTIPPTAGILKRWGTIKKSKAINTVLRGFRKEIGRMLNILNRRRR |
| 174 | gi\|158348408\|ref\|NP_722457.2\| anchored capsid protein [Dengue virus 1] | MNNQRKKTGRPSFNMLKRARNRVSTVSQLAKRFSKGLLSGQGPMKLVMAFIAFLRFLAIPPTAGILARWGSFKKNGAIKVLRGFKKEISNMLNIMNRRKRSVTMLLMLLPTALA |

TABLE 36-continued

| DENV POLYPEPTIDE SEQUENCES | | |
|---|---|---|
| SEQ ID NO: | Accession No. | Sequence |
| 175 | gi\|164654854\|ref\| YP_001531165.2\| Anchored capsid protein [Dengue virus 3] | MNNQRKKTGKPSINMLKRVRNRVSTGSQLAKRFSKGLL NGQGPMKLVMAFIAFLRFLAIPPTAGVLARWGTFKKSGA IKVLKGFKKEISNMLSIINQRKKTSLCLMMILPAALA |
| 176 | gi\|159024808\|ref\| NP_739581.2\| Anchored capsid protein [Dengue virus 2] | MNNQRKKAKNTPFNMLKRERNRVSTVQQLTKRFSLGM LQGRGPLKLFMALVAFLRFLTIPPTAGILKRWGTIKKSKA INTVLRGFRKEIGRMLNILNRRRRSAGMIIMLIPTVMA |
| 177 | gi\|73671168\|ref\| NP_740314.1\| anchored capsid (anchC) protein [Dengue virus 4] | MNQRKKVVRPPFNMLKRERNRVSTPQGLVKRFSTGLFS GKGPLRMVLAFITFLRVLSIPPTAGILKRWGQLKKNKAIK ILIGFRKEIGRMLNILNGRKRSTITLLCLIPTVMA |
| 178 | gi\|73671167\|ref\| NP_740313.1\| virion capsid (virC) protein [Dengue virus 4] | MNQRKKVVRPPFNMLKRERNRVSTPQGLVKRFSTGLFS GKGPLRMVLAFITFLRVLSIPPTAGILKRWGQLKKNKAIK ILIGFRKEIGRMLNILNGRKR |
| Envelope Protein 179 | gi\|164654853\|ref\| YP_001531168.2\| Envelope protein [Dengue virus 3] | MRCVGVGNRDFVEGLSGATWVDVVLEHGGCVTTMAKN KPTLDIELQKTEATQLATLRKLCIEGKITNITTDSRCPTQG EAVLPEEQDQNYVCKHTYVDRGWGNGCGLFGKGSLVT CAKFQCLEPIEGKVVQYENLKYTVIITVHTGDQHQVGNE TQGVTAEITPQASTTEAILPEYGTLGLECSPRTGLDFNEMI LLTMKNKAWMVHRQWFFDLPLPWASGATTETPTWNRK ELLVTFKNAHAKKQEVVVLGSQEGAMHTALTGATEIQN SGGTSIFAGHLKCRLKMDKLELKGMSYAMCTNTFVLKK EVSETQHGTILIKVEYKGEDAPCKIPFSTEDGQGKAHNGR LITANPVVTKKEEPVNIEAEPPFGESNIVIGIGDNALKINW YKKGSSIGKMFEATERGARRMAILGDTAWDFGSVGGVL NSLGKMVHQIFGSAYTALFSGVSWVMKIGIGVLLTWIGL NSKNTSMSFSCIAIGIITLYLGAVVQA |
| 180 | gi\|158828123\|ref\| NP_722460.2\| envelope protein [Dengue virus 1] | MRCVGIGNRDFVEGLSGATWVDVVLEHGSCVTTMAKD KPTLDIELLKTEVTNPAVLRKLCIEAKISNTTTDSRCPTQG EATLVEEQDTNFVCRRTFVDRGWGNGCGLFGKGSLITCA KFKCVTKLEGKIVQYENLKYSVIVTVHTGDQHQVGNETT EHGTTATITPQAPTSEIQLTDYGALTLDCSPRTGLDFNEM VLLTMKKKSWLVHKQWFLDLPLPWTSGASTSQETWNR QDLLVTFKTAHAKKQEVVVLGSQEGAMHTALTGATEIQ TSGTTTIFAGHLKCRLKMDKLILKGMSYVMCTGSFKLEK EVAETQHGTVLVQVKYEGTDAPCKIPFSSQDEKGVTQNG RLITANPIVTDKEKPVNIEAEPPFGESYIVVGAGEKALKLS WFKKGSSIGKMFEATARGARRMAILGDTAWDFGSIGGV FTSVGKLIHQIFGTAYGVLFSGVSWTMKIGIGILLTWLGL NSRSTSLSMTCIAVGMVTLYLGVMVQA |
| 181 | gi\|159024812\|ref\| NP_739583.2\| Envelope protein [Dengue virus 2] | MRCIGMSNRDFVEGVSGGSWVDIVLEHGSCVTTMAKNK PTLDFELIKTEAKQPATLRKYCIEAKLTNTTTESRCPTQGE PSLNEEQDKRFVCKHSMVDRGWGNGCGLFGKGGIVTCA MFRCKKNMEGKVVQPENLEYTIVITPHSGEEHAVGNDTG KHGKEIKITPQSSITEAELTGYGTVTMECSPRTGLDFNEM VLLQMENKAWLVHRQWFLDLPLPWLPGADTQGSNWIQ KETLVTFKNPHAKKQDVVVLGSQEGAMHTALTGATEIQ MSSGNLLFTGHLKCRLRMDKLQLKGMSYSMCTGKFKV VKEIAETQHGTIVIRVQYEGDGSPCKIPFEIMDLEKRHVL GRLITVNPIVTEKDSPVNIEAEPPFGDSYIIIGVEPGQLKLN WFKKGSSIGQMFETTMRGAKRMAILGDTAWDFGSLGGV FTSIGKALHQVFGAIYGAAFSGVSWTMKILIGVIITWIGM NSRSTSLSVTLVLVGIVTLYLGVMVQA |

TABLE 36-continued

| DENV POLYPEPTIDE SEQUENCES | | |
|---|---|---|
| SEQ ID NO: | Accession No. | Sequence |
| 182 | tr\|Q9IZI6\|Q9IZI6_9FLAV Envelope protein (Fragment) OS = Dengue virus 4 GN = E PE = 4 SV = 1 | MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVRIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCEVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGF |
| 183 | gi\|73671170\|ref\|NP_740316.1\|membrane (M) protein [Dengue virus 4] | SVALTPHSGMGLETRAETWMSSEGAWKHAQRVESWILRNPGFALLAGFMAYMIGQTGIQRTVFFVLMMLVAPSYG |
| 184 | gi\|158828127\|ref\|YP_001531167.1\|Membrane glycoprotein [Dengue virus 3] | SVALAPHVGMGLDTRTQTWMSAEGAWRQVEKVETWALRHPGFTILALFLAHYIGTSLTQKVVIFILLMLVTPSMT |
| 185 | gi\|158828122\|ref\|NP_722459.2\|membrane glycoprotein [Dengue virus 1] | SVALAPHVGLGLETRTETWMSSEGAWKQIQKVETWALRHPGFTVIALFLAHAIGTSITQKGIIFILLMLVTPSMA |
| 186 | gi\|159024811\|ref\|NP_739592.2\|Membrane glycoprotein [Dengue virus 2] | SVALVPHVGMGLETRTETWMSSEGAWKHVQRIETWILRHPGFTMMAAILAYTIGTTHFQRALIFILLTAVTPSMT |

Example 36. OVA Multitope In Vitro Screening Assay Kinetic Analysis

Figure 36:
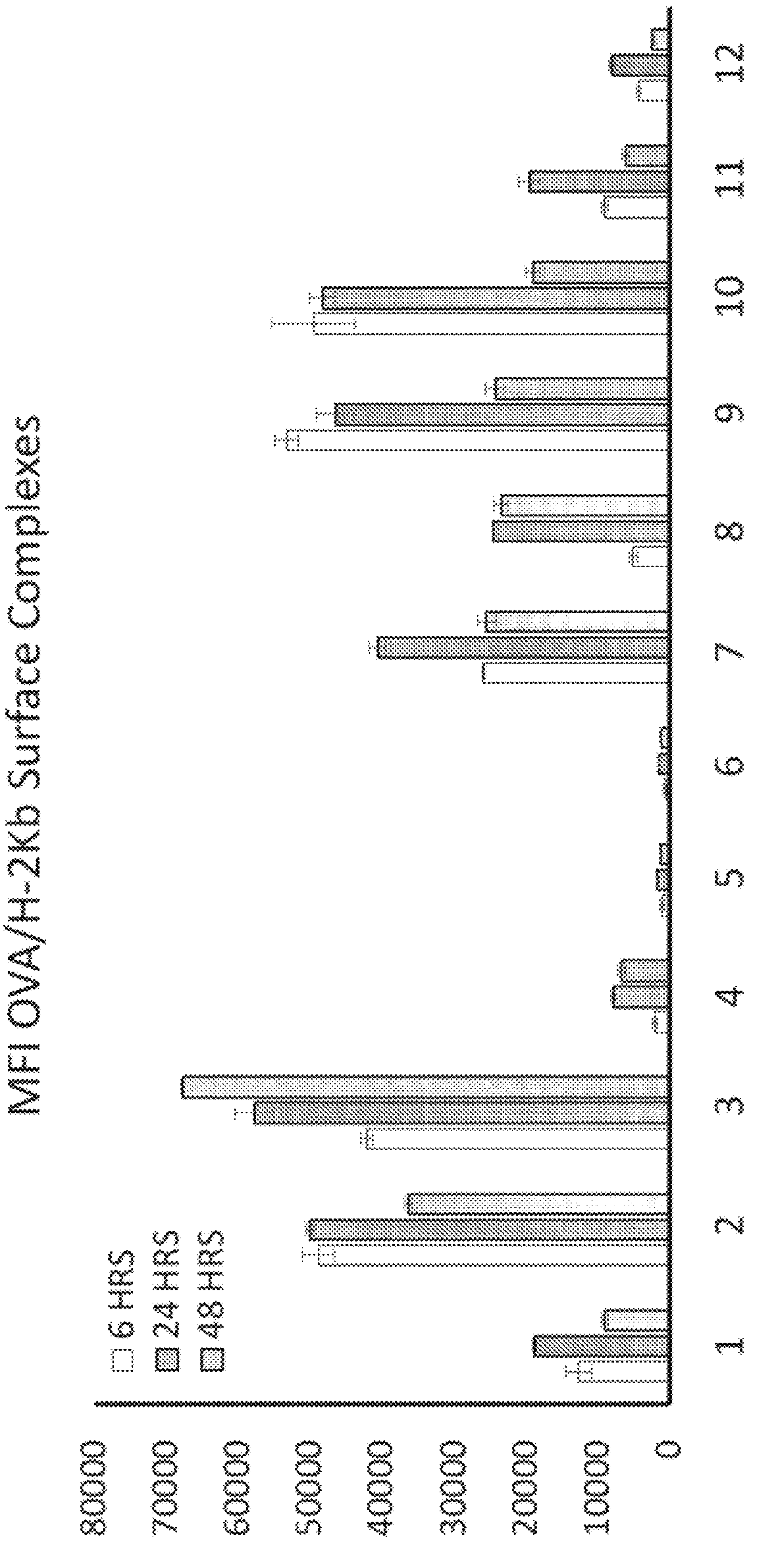
FIG. 36 is a graph showing the kinetics of OVA peptide presentation in Jawsii cells. All mRNAs tested are formulated in MC3 lipid nanoparticles.

As depicted in FIG. 35, antigen surface presentation is an inefficient process in the antigen presenting cells (APC). Peptides generated from proteasome degradation of the antigens are presented with low efficiency (only 1 peptide of 10000 degraded molecules is actually presented). Thus, priming of CD8 T cells with APCs provides insufficient densities of surface peptide/MHC I complexes, resulting in weak responders exhibiting impaired cytokine secretion and decreased memory pool. To improve DENV mRNA vaccines encoding concatemeric DENV antigens, an in vitro assay was designed to test the linkers used to connect peptide repeats, the number of peptide repeats, and sequences known to enhance antigen presentation.

mRNA constructs encoding one or more OVA epitopes were configured with different linker sequences, protease cleavage sites, and antigen presentation enhancer sequences. Their respective sequences were as shown in Table 37. To perform the assay, 200 ng of each MC3-formulated mRNA construct was transfected into JAWSII cells in a 24-well plate. Cells were isolated at 6, 24, and 48 hours post transfection and stained with fluorescently-labeled Anti-Mouse OVA257-264 (SIINFEKL) peptide bound to H-2Kb. Staining was analyzed on a LSRFortessa flow cytometer. Samples were run in triplicate. The Mean Fluorescent Intensity (MFI) for each mRNA construct was measured and shown in FIG. 36. Constructs 2, 3, 7, 9, and 10 showed enhanced surface presentation of the OVA epitope, indicating that the configurations of these constructs may be used for DENV mRNA vaccine. Construct 5 comprises a single OVA peptide and a KDEL sequence that is known to prevent the secretion of a protein. Construct 5 showed little surface antigen presentation because the secretion of the peptide was inhibited.

Example 37. Antibody Binding to DENV-1, 2, 3, and 4 prME Epitopes

Figure 37:
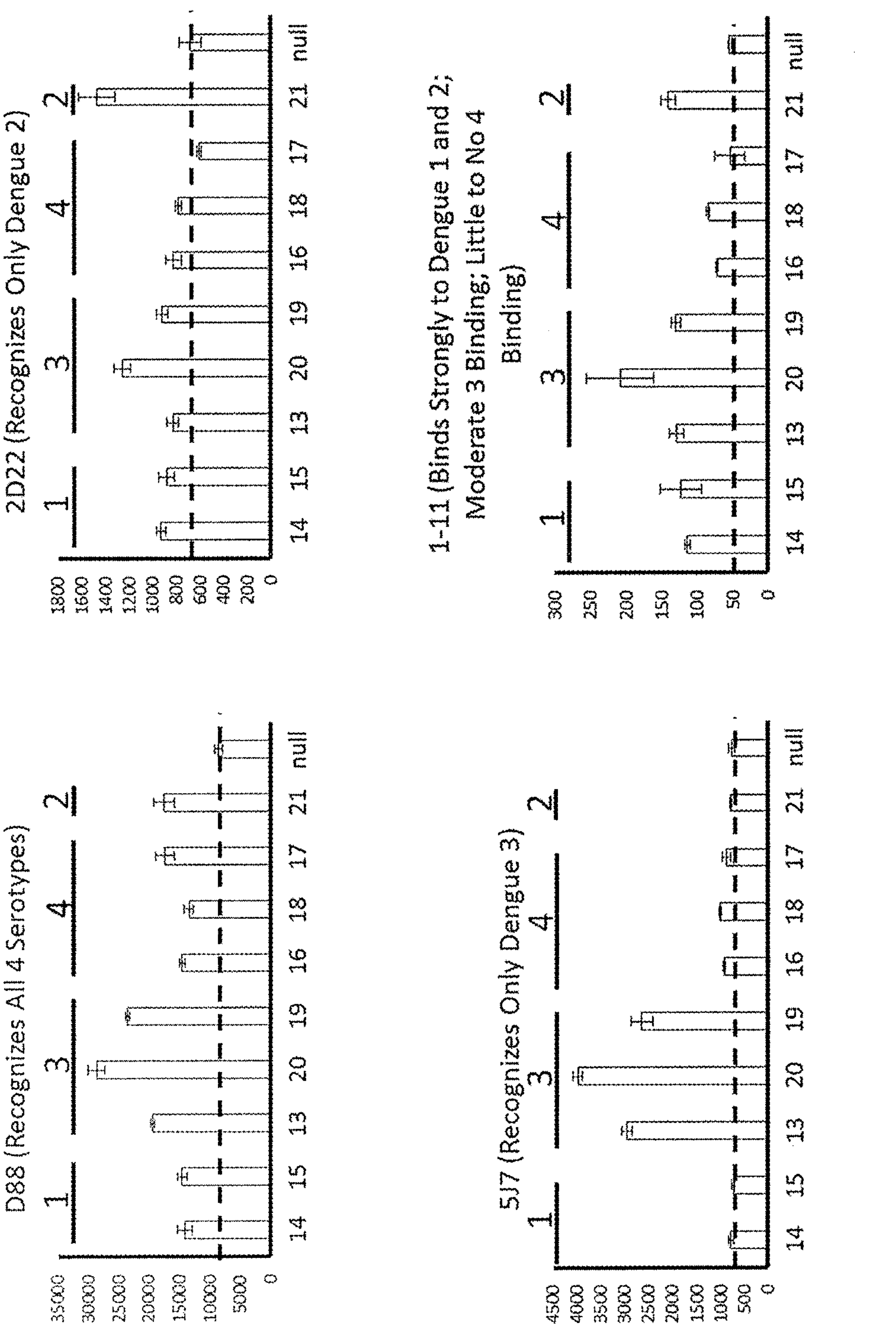
FIG. 37 is a graph showing the Mean Fluorescent Intensity (MFI) of antibody binding to DENV-1, 2, 3, and 4 prME epitopes presented on the cell surface.

DENV mRNA vaccines encoding concatemeric antigen epitopes were tested for binding to antibodies known to recognize one or more DENV serotypes. To test antibody binding to the epitopes, 200 ng of DENV mRNA vaccines encoding different Dengue prME epitopes were transfected into HeLa cells in 24-well plates using the TransitIT-mRNA Transfection Kit (Mires Bio). The DENV mRNA vaccine constructs are shown in Table 34. Transfections were done in triplicate. After 24 hours, surface expression was detected using four different antibodies (10 μg/mL) followed by either goat-anti-human or anti-mouse AF700 secondary antibody (1/500). Signal generated from antibody binding are shown as Mean Fluorescent Intensity (MFI) (FIG. 37). Antibody D88 is known to recognize all 4 serotypes and bound to all antigen epitopes encoded by the DENV mRNA vaccine constructs tested. Antibody 2D22 is known to recognize only DENV 2 and preferentially bound to construct 21, which encodes DENV 2 antigen epitopes. Antibody 2D22 also showed weak binding to epitopes of other DENV serotypes. Antibody 5J7 is known to recognize only DENV 3 and only bound to antigen epitopes encoded by constructs 13, 19, and 20, which encode DENV 3 antigen epitopes. Antibody 1-11 is known to bind strongly to DENV 1 and 2, to bind weakly to DENV 3 and to bind little DENV 4. Antibody 1-11 bound to DENV 1, 2, and 3, and binding to DENV 3 antigen epitopes was stronger than binding to DENV 1 or 2 (FIG. 37).

TABLE 37 mRNA constructs that encode one or more OVA epitopes

| Construct | # of Peptides/ Repeats | Linker | Antigen Presentation Enhancer Sequence | Amino acid Sequence | SEQ ID NO: |
|---|---|---|---|---|---|
| 1 | 8 OVA (8mer) Repeats (Flanking AA) | G/S | — | MLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTE | 187 |
| 2 | 8 OVA (8mer) Repeats (Flanking AA) | Cathepsin B Cleavage Site (GFLG) | — | MLESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTE | 188 |
| 3 | 8 OVA (8mer) Repeats (Flanking AA) | — | Human MHCI Secretion Peptide/Cytoplasmic Domain | MRVTAPRTVLLLLSAALALTETWALESIINFEKLTELESIINFEKLTELESIINFEKLTELESIINFEKLTELESIINFEKLTELESIINFEKLTELESIINFEKLTELESIINFEKLTEGSIVGIVAGLAVLAVVVIGAVVATVMCRRKSSGGKGGSYSQAASSDSAQGSDVSLTA | 189 |
| 4 | 8 OVA (8mer) Repeats (Flanking AA) | Cathepsin B Cleavage Site (GFLG) | Human MHCI Secretion Peptide/Cytoplasmic Domain | MRVTAPRTVLLLLSAALALTETWALESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTEGSIVGIVAGLAVLAVVVIGAVVATVMCRRKSSGGKGGSYSQAASSDSAQGSDVSLTA | 190 |
| 5 | Single OVA | — | KDEL | MSIINFEKLKDEL | 191 |
| 6 | Single OVA (Flanking AA) | — | Human MHCI Secretion Peptide/Cytoplasmic Domain | MRVTAPRTVLLLLSAALALTETWALESIINFEKLTEGSIVGIVAGLAVLAVVVIGAvvATvmCFRKSSGGKGGSYSQAASSDSAQGSDVSLTA | 192 |
| 7 | 8 OVA (8mer) Repeats | Cathepsin B Cleavage Site (GFLG) | Murine Ig Kappa Signal Peptide(Igκ) | METDTLLLWVLLLWVPGSTGDSIINFEKLGFLGSIINFEKLGFLGSIINFEKLGFLGSIINFEKLGFLGSIINFEKLGFLGSIINFEKLGFLGSIINFEKLGFLGSIINFEKL | 193 |

TABLE 37-continued

| mRNA constructs that encode one or more OVA epitopes | | | | | |
|---|---|---|---|---|---|
| Construct | # of Peptides/ Repeats | Linker | Antigen Presentation Enhancer Sequence | Amino acid Sequence | SEQ ID NO: |
| 8 | 8 OVA (8mer) Repeats (Flanking AA) | G/S | Human MHCI Secretion Peptide/Cytoplasmic Domain | MRVTAPRTVLLLLSAALA LTETWALESIINFEKLTE GGGGSGGGGSLESIINFE KLTEGGGGSGGGGSLESI INFEKLTEGGGGSGGGGS LESIINFEKLTEGGGGSG GGGSLESIINFEKLTEGG GGSGGGGSLESIINFEKL TEGGGGSGGGGSLESIIN FEKLTEGGGGSGGGGSLE SIINFEKLTEGSIVGIVA GLAVLAVVVIGAVVATVM CRRKSSGGKGGSYSQAAS SDSAQGSDVSLTA | 194 |
| 9 | 8 OVA (8mer) Repeats (Flanking AA) | — | — | MLESIINFEKLTELESII NFEKLTELESIINFEKLT ELESIINFEKLTELESII NFEKLTELESIINFEKLT ELESIINFEKLTELESII NFEKLTE | 195 |
| 10 | Single OVA | — | — | MSIINFEKL | 196 |
| 11 | 8 OVA (8mer) Repeats | Cathepsin B Cleavage Site (GFLG) | Murine Ig Kappa Signal Peptide(Igκ) and PEST | METDTLLLWVLLLWVPGS TGDHPFTEDDAVDPNDSD IDPESRSIINFEKLGFLG SIINFEKLGFLGSIINFE KLGFLGSIINFEKLGFLG SIINFEKLGFLGSIINFE KLGFLGSIINFEKLGFLG SIINFEKL | 197 |
| 12 | 8 OVA (8mer) Repeats | Cathepsin B Cleavage Site (GFLG) | Murine MHC Class I Cytoplasmic Domain (MITD) | MSIINFEKLGFLGSIINF EKLGFLGSIINFEKLGFL GSIINFEKLGFLGSIINF EKLGFLGSIINFEKLGFL GSIINFEKLGFLGSIINF EKL*PPPSTVSNMIIIEVL IVLGAVINIGAMVAFVLK SKRKIGGKGGVYALAGGS NSIHGSALFLEAFKA* | 198 |

TABLE 38

| DENV mRNA vaccine constructs tested for antibody binding or in challenge studies | | |
|---|---|---|
| Construct | mRNA Name | SEQ ID NO |
| 13 | DEN3_prME_PaH881/88_AF349753.1 | 199 |
| 14 | DEN1_prME_West_Pac_AY145121.1 | 200 |
| 15 | DEN1_prME_PUO-359_AAN32784.1 | 201 |
| 16 | DEN4_prME_DHF_Patient_JN638571.1 | 202 |
| 17 | DEN4_prME_DENV4/CN/GZ29/2010_KP723482.1 | 203 |
| 18 | DEN4_prME_rDEN4_AF326825.1 | 204 |
| 19 | DEN3_prME_L11439.1 | 205 |
| 20 | DEN3_prME_D3/Hu/TL129NIID/2005_AB214882 | 206 |
| 21 | DENV2_prME_Peru_IQT2913_1996 | 207 |
| 22 | DENV2_prME_Thailand-168_1979 | 208 |
| 23 | DENV2_prME_Thailand_PUO-218_1980 (Sanofi strain) | 209 |
| 24 | DEN2_D2Y98P_PRME80_Hs3_LSP | 210 |
| 25 | Non-H2Kb multitope | 211 |
| 26 | H2Kb multitope | 212 |

Example 38. DENY prME Challenge Study in Cynomolgus (Cyno) Monkey Model

Shown in Table 39 is the design of DENV prME challenge study in cynomolgus (cyno) money. Indicated DENV mRNA vaccine encoding prME antigen epitopes, or vaccines thereof, are used to immunize cyno. The vaccines are formulated in lipid nanoparticles (e.g., MC3 formulation) and administered to the cyno monkeys intramuscularly on day 0, 21, and 42. Dosages of the vaccines are 250 μg or 5 μg per immunization. In experiments where a combination of different DENV mRNA vaccines are used, 250 μg or 5 μg of each mRNA vaccine is used. FLAG-tagged H10N8 flu vaccine is used as control at a dosage of 250 μg per immunization. Naïve cyno monkeys without immunization are also used as control. Cyno monkey sera are collected on days 20, 41, 62, and 92 post initial immunization and used for serotype-specific neutralization assays.

Immunized cyno monkeys are challenged on day 63 post initial immunization with indicated DENV viruses. Cyno monkey sera are collected on days 62 (pre-challenge), 63-66, 68, 70, 72, 76, and 92 (end of life) to determine serum viral load.

TABLE 39

DENV prME Challenge Study Design in Cynomolgus (cyno) Monkey

| Group n = 3 | Vaccine | Vaccine Schedule | Dosage/Route | Challenge |
|---|---|---|---|---|
| 1 | Dengue 1 prME | Day 0, 21, 42 | IM, LNP 250 μg | Challenge with Dengue 1/03135 s.c |
| 2 | (Construct 15) | | IM, LNP 5 μg | (5log PFU) |
| 3 | Dengue 2 prME | Day 0, 21, 42 | IM, LNP 250 μg | Challenge with Dengue 2/99345 s.c |
| 4 | (Construct 21) | | IM, LNP 5 μg | (5log PFU) |
| 5 | Dengue 3 prME | Day 0, 21, 42 | IM, LNP 250 μg | Challenge with Dengue 3/16562 s.c |
| 6 | (Construct 19) | | IM, LNP 5 μg | (5log PFU) |
| 7 | Dengue 4 prME | Day 0, 21, 42 | IM, LNP 250 μg | Challenge with Dengue 4/1036 s.c |
| 8 | (Construct 17) | | IM, LNP 5 μg | (5log PFU) |
| 9 | prME Combo (Post-Formulation | Day 0, 21, 42 | IM, LNP 1000 μg Total (250 μg of each) | Challenge with Dengue 1/03135 s.c (5log PFU) |
| 10 | Mix) (Constructs 15, 17, 19, and 21) | | IM, LNP 20 μg Total (5 μg of each) | |
| 11 | prME Combo (Post-Formulation | Day 0, 21, 42 | IM, LNP 1000 μg Total (250 μg of each) | Challenge with Dengue 2/99345 s.c (5log PFU) |
| 12 | Mix) (Constructs 15, 17, 19, and 21) | | IM, LNP 20 μg Total (5 μg of each) | |
| 13 | prME Combo (Post-Formulation | Day 0, 21, 42 | IM, LNP 1000 μg Total (250 μg of each) | Challenge with Dengue 3/16562 s.c (5log PFU) |
| 14 | Mix) (Constructs 15, 17, 19, and 21) | | IM, LNP 20 μg Total (5 μg of each) | |
| 15 | prME Combo (Post-Formulation | Day 0, 21, 42 | IM, LNP 1000 μg Total (250 μg of each) | Challenge with Dengue 4/1036 s.c (5log PFU) |
| 16 | Mix) (Constructs 15, 17, 19, and 21) | | IM, LNP 20 μg Total (5 μg of each) | |
| 17 | prME Combo (Post-Formulation Mix) (Constructs 15, 17, 19, and 22) | Day 0, 21, 42 | IM, LNP 1000 μg Total (250 μg of each) | Challenge with Dengue 2/99345 s.c (5log PFU) |
| 18 | H10N8-FLAG | Day 0, 21, 42 | IM, LNP 250 μg | Challenge with Dengue 2/99345 s.c (5log PFU) |
| 19 | Naive | — | — | Challenge with Dengue 1/03135 s.c (5log PFU) |
| 20 | Naive | — | — | Challenge with Dengue 2/99345 s.c (5log PFU) |
| 21 | Naive | — | — | Challenge with Dengue 3/16562 s.c (5log PFU) |
| 22 | Naive | — | — | Challenge with Dengue 4/1036 s.c (5log PFU) |

Figure 38A:
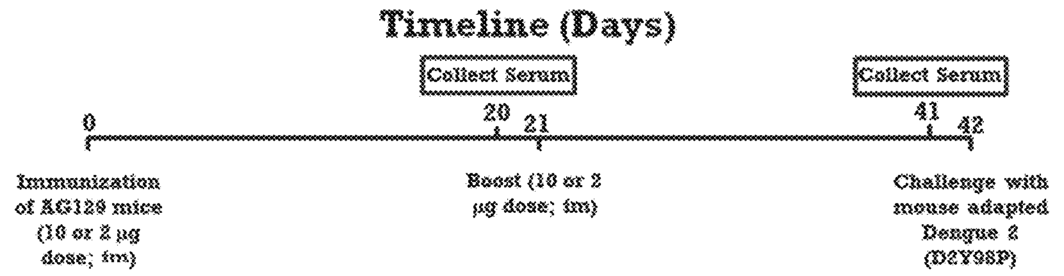
FIGS. 38A-38D are graphs showing the design and the results of a challenge study in AG129 mice.
Figure 38B:
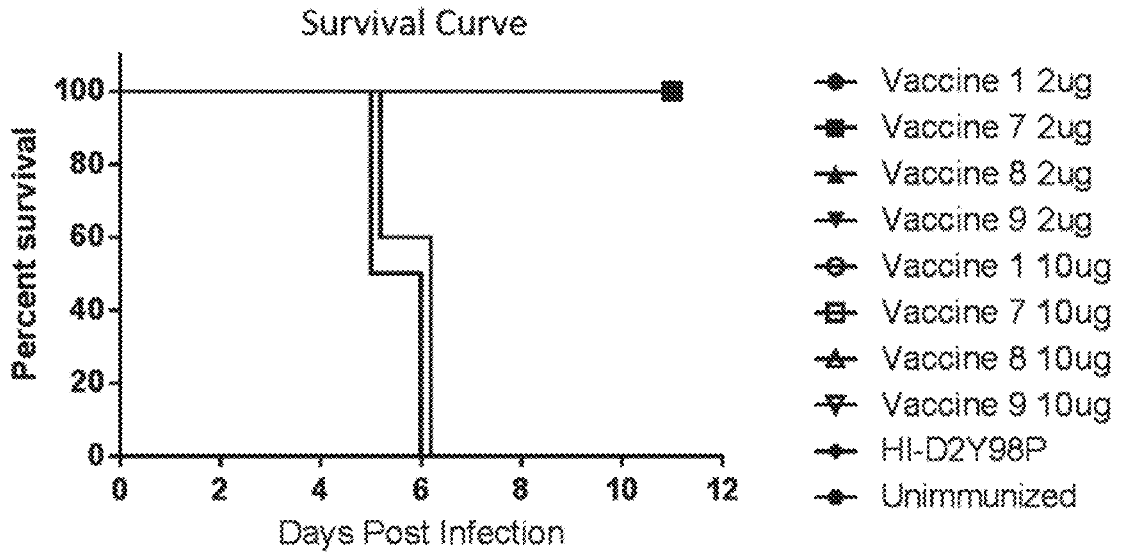

Collect serum on day 20, 41, 62, and 92 for serotype-specific neutralization assay Collect serum on day 62 (pre-challenge), 63-66, 68, 70, 72, 76, and 92 (end of In-life) to determine serum viral load Example 39: Dengue 2 prME Challenge Study in AG129 Mice The instant study was designed to evaluate the efficacy of four DENV mRNA vaccine constructs (constructs 21-24 in Table 38) in AG129 mice challenge assays. The schedule of the challenge study was shown in FIG. 38A. The DENV mRNA vaccines were formulated in lipid nanoparticles (e.g., MC3 formulation) and administered to the AG129 mice intramuscularly on days 0 and 21. Dosage of the vaccines were 2 μg or 10 μg per immunization. Heat inactivated D2Y98P strain was used as a negative control to vaccinate the mice. Naïve AG129 mice without immunization were also used as control.

Figure 38C:
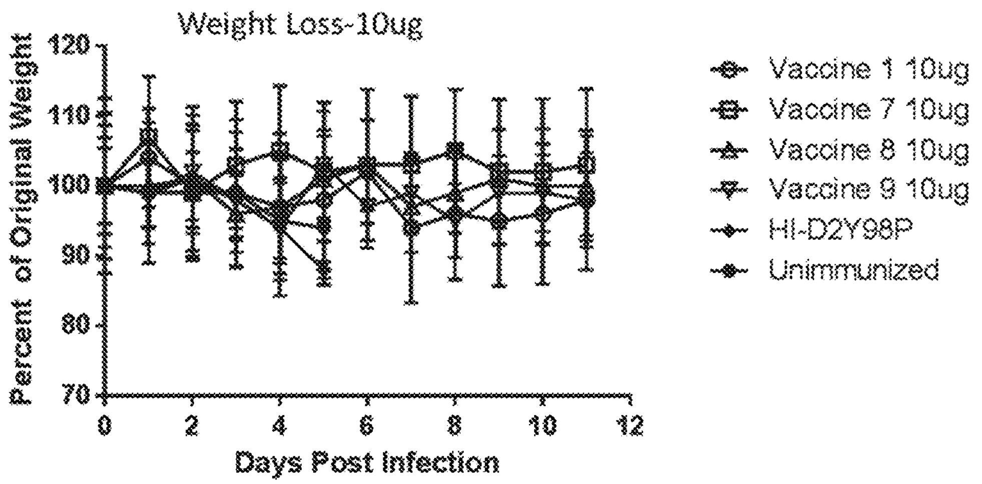
Figure 38D:
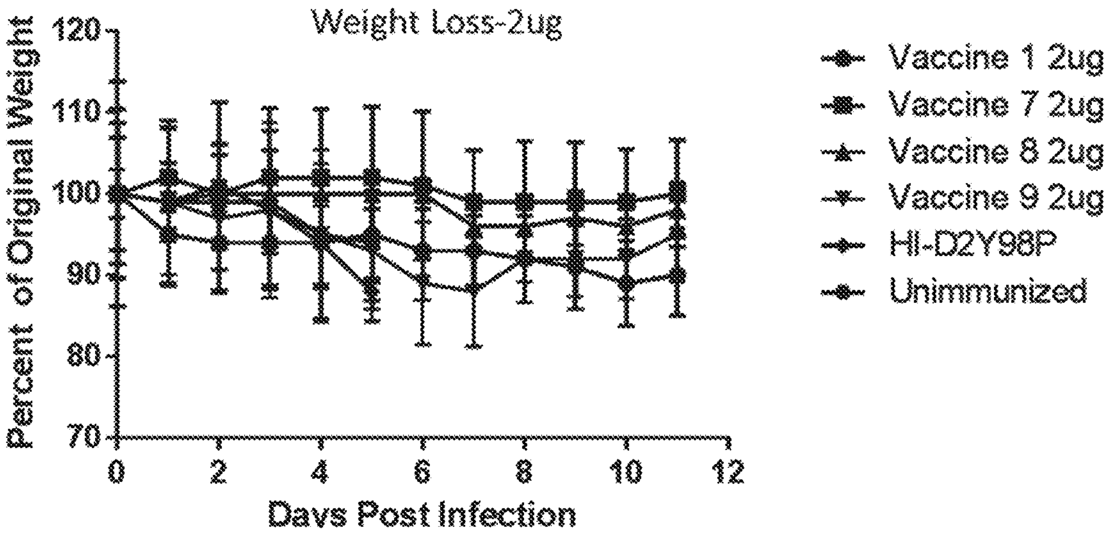

Immunized AG129 mice were challenged on day 42 post initial immunization with Dengue D2Y98P virus (s.c., 1e5 PFU per mouse). AG129 mice sera were collected on days 20 and 41 post initial immunization and used for serotype-specific neutralization assays. Mice immunized with any of the four DENV mRNA vaccine constructs survived, while the control mice died. These data demonstrate that, after lethal challenge, there was 100% protection provided by each mRNA vaccine construct, regardless of dose. The weights and health of the mice were monitored and the results were plotted in FIGS. 38C-38D.

Figure 39:
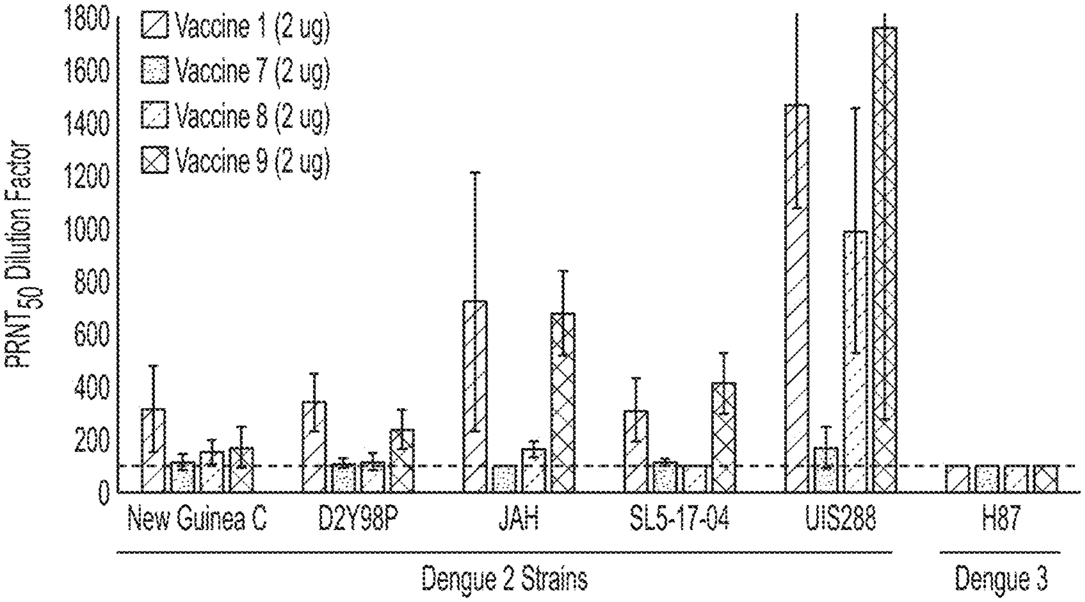
FIG. 39 is a graph showing the results of an in vitro neutralization assay using serum from mice immunized with the DENV mRNA vaccines in FIGS. 39A-39D.
Figure 40A:
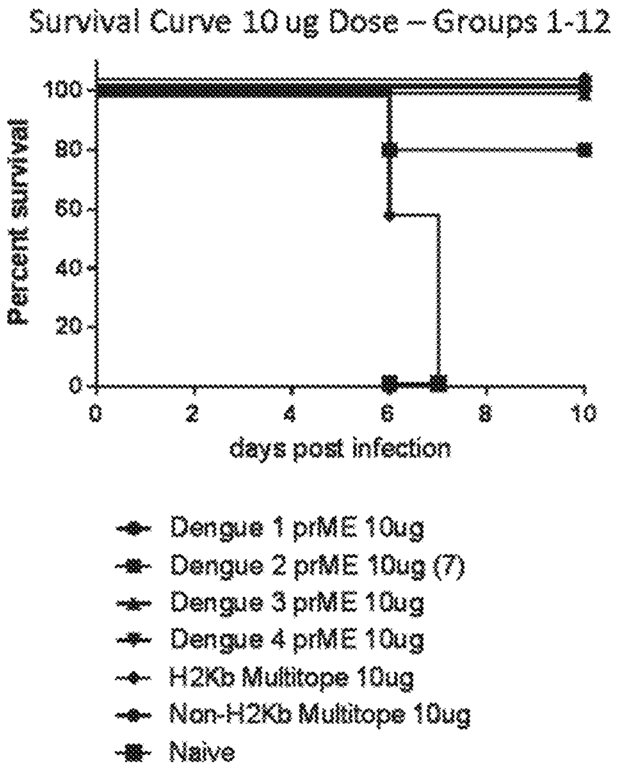
FIGS. 40A-40I are graphs showing the results of a challenge study in AG129 mice. The challenge study design is shown in Table 40.
Figure 40B:
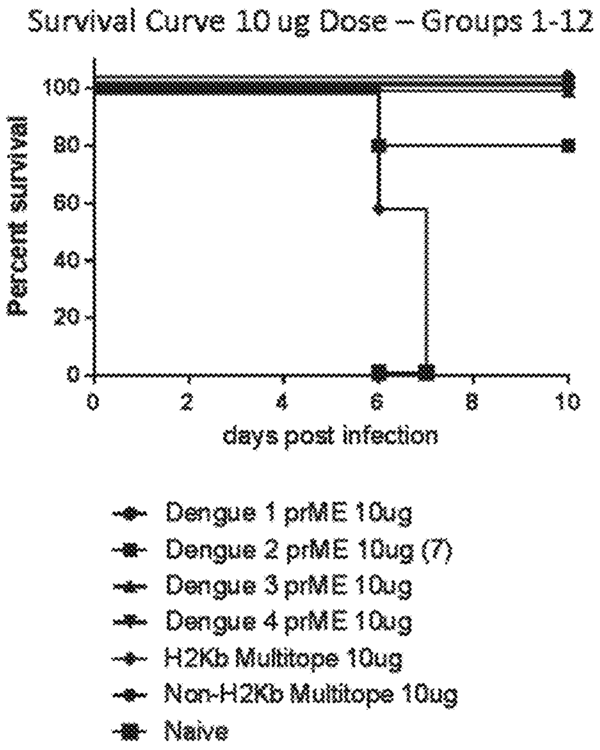
Figure 40C:
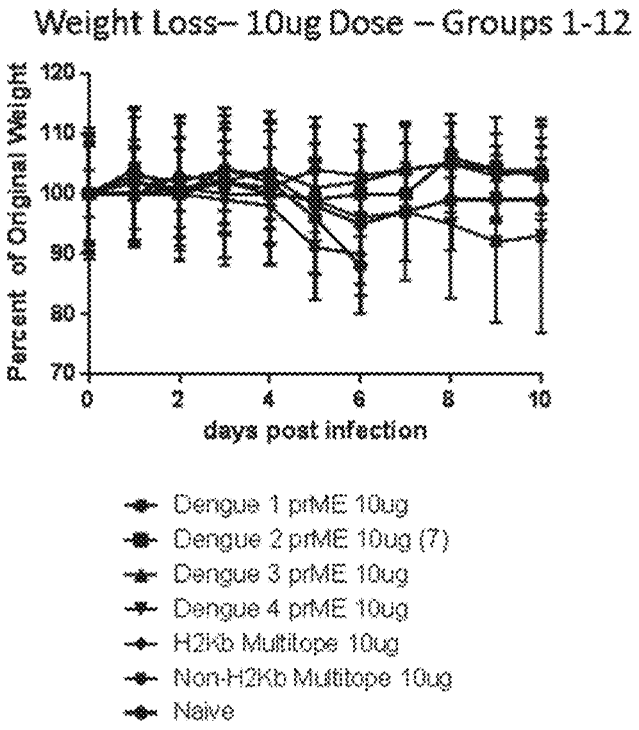
Figure 40D:
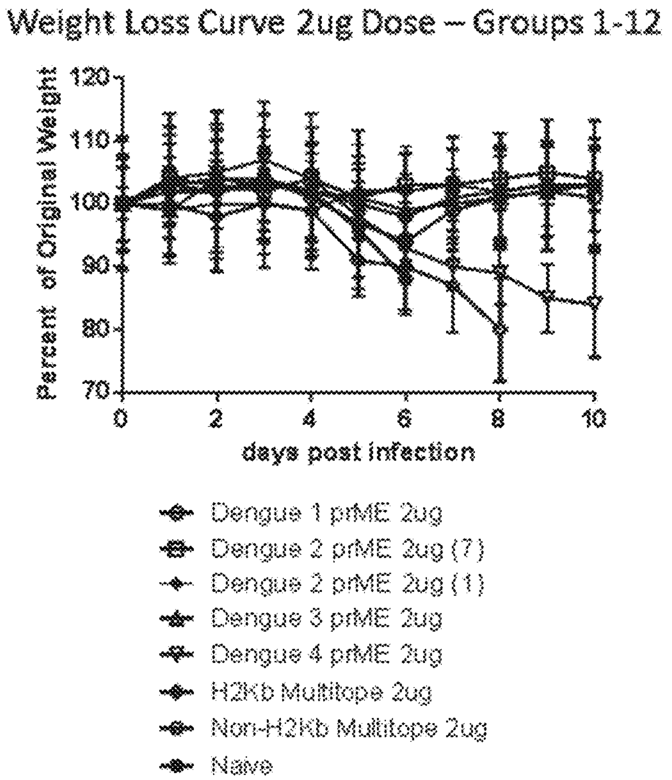
Figure 40E:
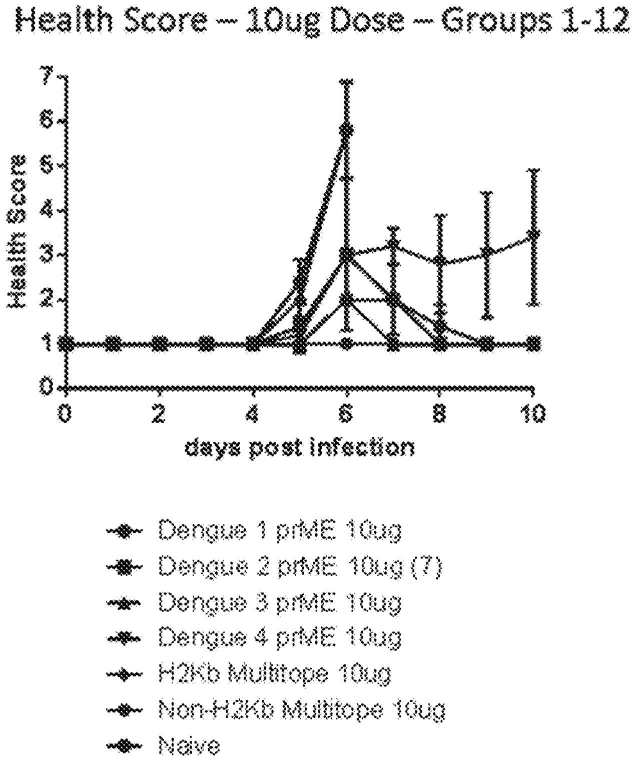
Figure 40F:
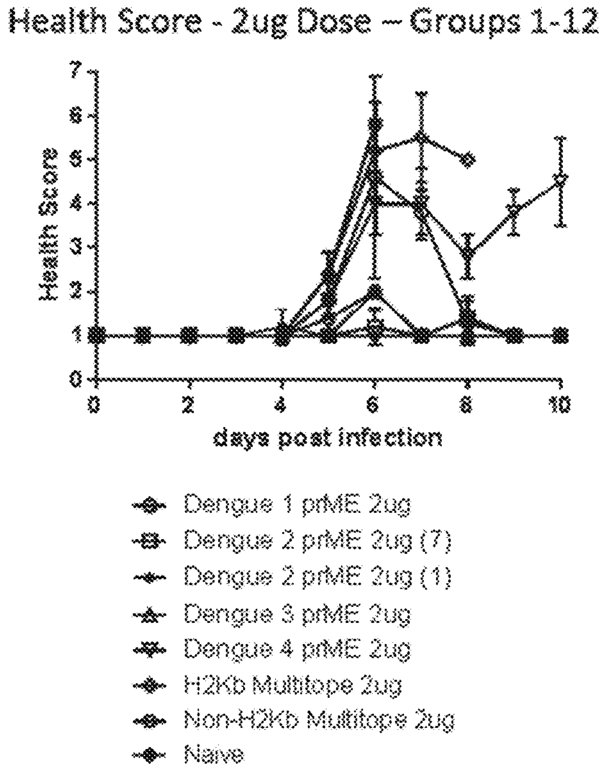
Figure 40G:
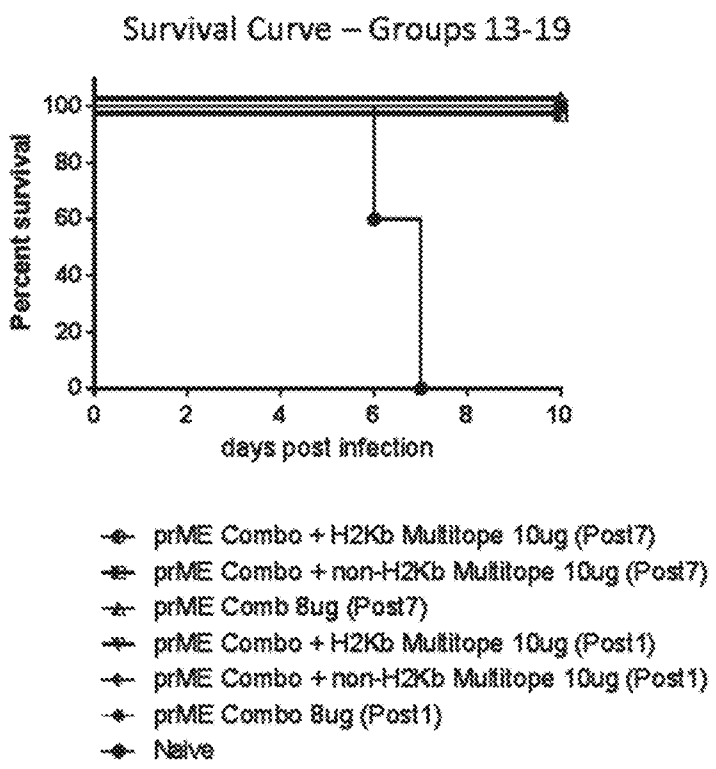
Figure 40H:
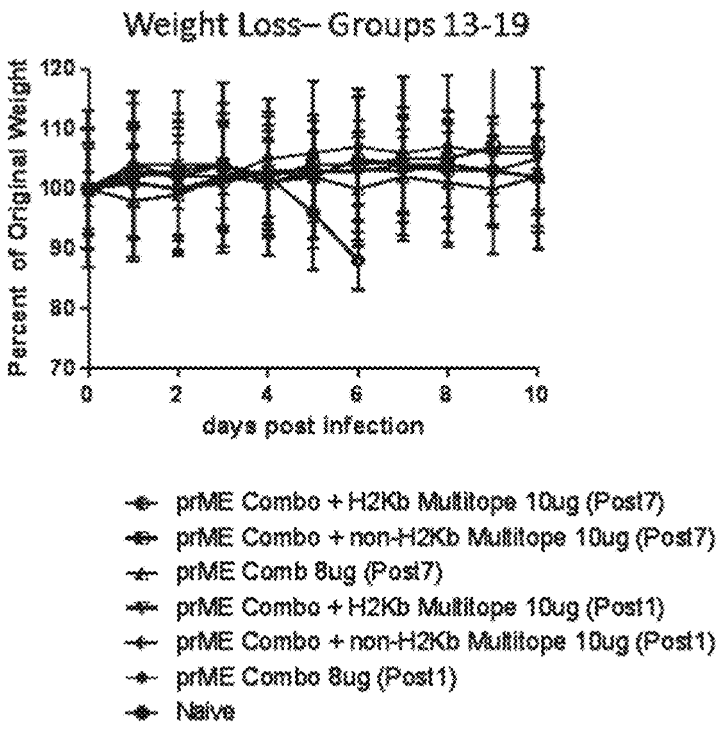
Figure 40I:
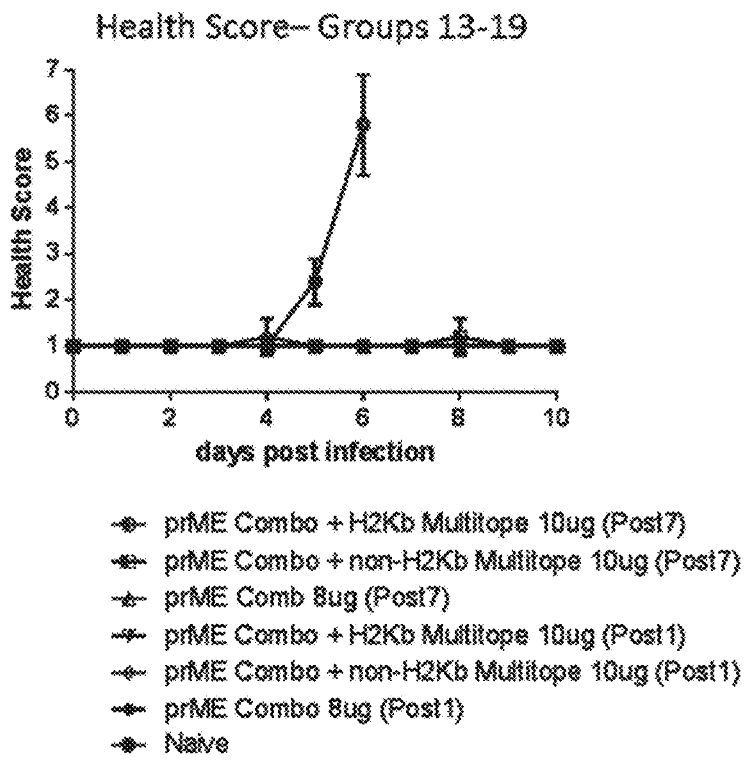

Mice sera collected from mice immunized with 2 μg of the DENV mRNA vaccines were able to neutralize several DENV 2 strains and variations in the neutralization ability between the tested mRNA vaccines and between different DENV 2 strains were observed (FIG. 39).

Example 40: DENY prME Challenge Study in AG129 Mice Model

Shown in Table 40 is the design of a DENV prME challenge study in AG129 mice, including the mRNA constructs tested, the vaccination schedule, the dosage, the challenge strains, and the serum collection schedule.

Indicated DENV mRNA vaccine encoding prME antigen epitopes, or vaccines thereof, were used to immunize AG129 mice. The vaccines were formulated in lipid nanoparticles (e.g., MC3 formulation) and administered to the mice intramuscularly on days 0 and 21. Dosages of the vaccines were 2 μg or 10 μg per immunization. In experiments where a combination of different DENV mRNA vaccines were used, 2 μg of each mRNA vaccine was used. Naïve AG129 mice without immunization were used as control. AG129 mice sera were collected on days 20 and 41 post initial immunization and used for serotype-specific neutralization assays.

Immunized AG129 mice were challenged on day 42 post initial immunization with Dengue D2Y98P virus (s.c., 1e5 PFU per mouse). The weights and health of the mice were monitored for 14 days post infection and the results were plotted in FIGS. 40A-40I.

TABLE 40

DENV prME Challenge Study Design in AG129 Mice

| Group n = 5 | Vaccine | Vaccine Schedule | Dosage/Route | Serum/PBMCs | Challenge | Readout |
|---|---|---|---|---|---|---|
| 1 | Dengue 1 prME (Construct 15) | Day 0, 21 | IM, LNP, 10 μg | Collect serum on day 20 and 41 for serotype-specific neutralization assay | Challenge with 1e5 PFU per mouse of D2Y98P SC injection (Day 42) | Monitor weights and health for 14 days p.i. |
| 2 | | Day 0, 21 | IM, LNP, 2 μg | | | |
| 3 | Dengue 2 prME | Day 0, 21 | IM, LNP, 10 μg | | | |
| 4 | (Construct 21) | Day 0, 21 | IM, LNP, 2 μg | | | |
| 5 | Dengue 3 prME | Day 0, 21 | IM, LNP, 10 μg | | | |
| 6 | (Construct 19) | Day 0, 21 | IM, LNP, 2 μg | | | |
| 7 | Dengue 4 prME | Day 0, 21 | IM, LNP, 10 μg | | | |
| 8 | (Construct 17) | Day 0, 21 | IM, LNP, 2 μg | | | |
| 9 | H2Kb Multitope | Day 0, 21 | IM, LNP, 10 μg | Collect and cryopreserve | | |
| 10 | (Construct 25) | Day 0, 21 | IM, LNP, 2 μg | PBMCs on day 20 and 41; Ship to | | |
| 11 | Non-H2Kb Multitope | Day 0, 21 | IM, LNP, 10 μg | Valera | | |
| 12 | (Construct 26) | Day 0, 21 | IM, LNP, 2 μg | | | |
| 13 | prME Combo + H2Kb Multitope (Constructs 15, 17, 19, and 21) (Post7) | Day 0, 21 | IM, LNP, 10 μg Total (2 μg of each) | Collect serum on day 20 and 41 for serotype-specific neutralization assay | | |

TABLE 40-continued

| DENV prME Challenge Study Design in AG129 Mice | | | | | | |
|---|---|---|---|---|---|---|
| Group n = 5 | Vaccine | Vaccine Schedule | Dosage/Route | Serum/PBMCs | Challenge | Readout |
| 14 | prME Combo + non-H2Kb Multitope (Constructs 15, 17, 19, 21, and 26) (Post7) | Day 0, 21 | IM, LNP, 10 μg Total (2 μg of each) | | | |
| 15 | prME Combo (Constructs 15, 17, 19, and 21) (Post7) | Day 0, 21 | IM, LNP, 8 μg Total (2 μg of each) | | | |
| 16 | prME Combo + H2Kb Multitope (Constructs 15, 17, 19, 21 and 25) (Post1) | Day 0, 21 | IM, LNP, 10 μg Total (2 μg of each) | | | |
| 17 | prME Combo + non-H2Kb Multitope (Constructs 15, 17, 19, 21, and 26) (Post1) | Day 0, 21 | IM, LNP, 10 μg Total (2 μg of each) | | | |
| 18 | prME Combo (Constructs 15, 17, 19, and 21) (Post1) | Day 0, 21 | IM, LNP, 8 μg Total (2 μg of each) | | | |
| 19 | Dengue 2 prME (Construct 22) | Day 0, 21 | IM, LNP, 2 μg | Collect serum on day 20 and 41 for Dengue 2-specific neutralization assay | | |
| 20 | Naive | Day 0, 21 | Tris/Sucrose | | | |

Example 41: Virus-Like Particles

Figure 41:
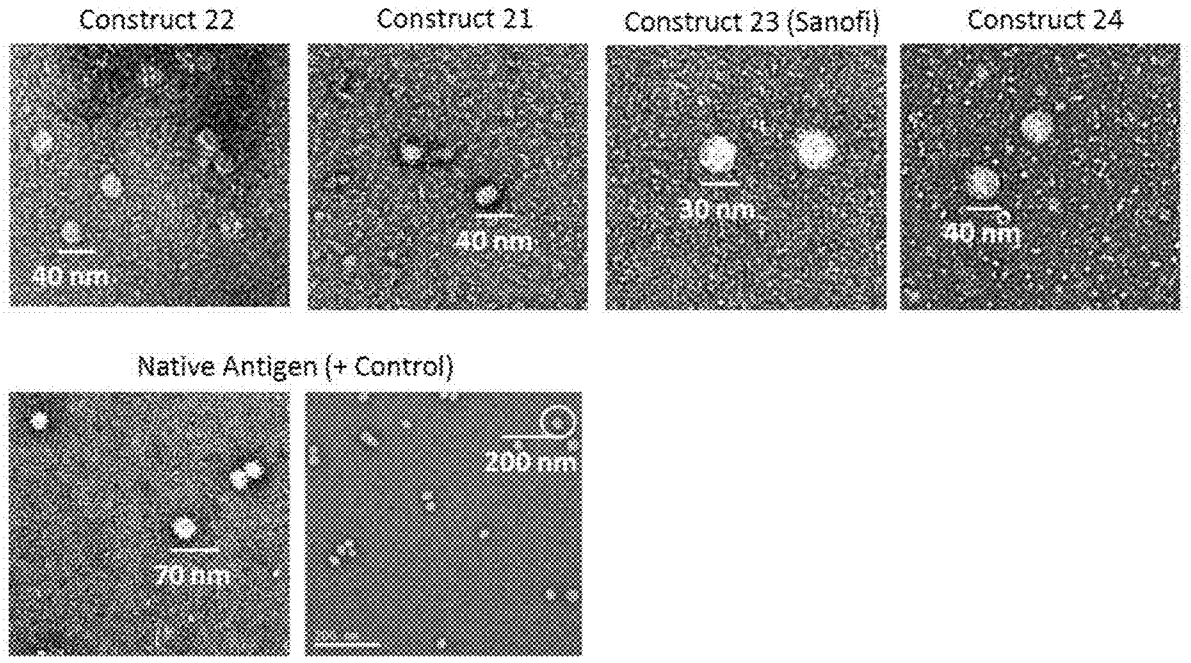
FIG. 41 is a negative-stain electron microscopy image of the virus-like particles (VLPs) assembled from the antigens (prME) encoded by the DENV mRNA vaccines. DENV mRNA vaccine constructs 21-24 in Table 38 were tested. Construct 23 is the vaccine construct used by Sanofi in its DENV vaccines. Constructs 21, 22, and 24 produced more uniform VLPs, suggesting that these VLPs may be more superior in their immunogenicity than the VLPs produced from construct 23.

The antigens produced from the DENV prME mRNA vaccines of the present disclosure, when expressed, are able to assemble into virus-like particles (VLPs). The instant study was designed to evaluate the immunogenicity of the VLPs by negative stain electron microscope imaging. As shown in FIG. 41, DENV mRNA vaccine constructs 21-24 were expressed and VLPs were assembled an isolated. The VLPs were visualized under negative stain electron microscopy. Construct 23 is the vaccine construct used by Sanofi in its DENV vaccines. Constructs 21, 22, and 24 produced more uniform VLPs, suggesting that these VLPs may be more superior in their immunogenicity than the VLPs produced from construct 23.

Example 42: Efficacy of CHIKV mRNA Vaccine X Against CHIKV in AG129 Mice

Study Design

Chikungunya virus (CHIKV) 181/25 strain is an attenuated vaccine strain that was developed by the US Army via multiple plaque-to-plaque passages of the 15561 Southeast Asian human isolate (Levitt et al.). It is well tolerated in humans and is highly immunogenic. It produces small plaques and has decreased virulence in infant mice and nonhuman primates. When the attenuated vims is administered to immunodeficient AG129 mice (lacking the IFN-α/β and γ receptors) the mice succumb to a lethal disease within 3-4 days with ruffled fur and weight loss (Partidos, et al. 2011 Vaccine).

This instant study was designed to evaluate the efficacy of CHIKV candidate vaccines as described herein in AG129 mice (Table 41). The study consisted of 14 groups of female 6-8 week old AG129 mice (Table 41). Groups 1-4, 7-8, and 10-15 were vaccinated with CHIKV vaccine X via the intramuscular (IM; 0.05 mL) route on Day 0 and select groups received an additional boost on Day 28. Control Groups 9 and 16 received vehicle (PBS) only on Days 0 and 28 via IM route (0.05 mL). Regardless of vaccination schedule, Groups 1-4 and 7-9 were challenged on Day 56 while Groups 10-16 were challenged on Day 112 using the CHIKV 181/25 strain (stock titer $3.97\times10^7$ PFU/mL, challenge dose $1\times10^4$ PFU/mouse). For virus challenge, all mice received a lethal dose ($1\times10^4$ PFU) of Chikungunya (CHIK) strain 181/25 via intradermal (ID) route (0.050 mL via footpad). All mice were monitored for 10 days post infection for weight loss, morbidity, and mortality. Each mice was assigned a heath score based on Table 5. Mice displaying severe illness as determined by >30% weight loss, a health score of higher than 5, extreme lethargy, and/or paralysis were euthanized with a study endpoint of day 10 post virus challenge. Test bleeds via retro-orbital (RO) collection were performed on mice from all groups on Days −3, 28, and 56. Mice from Groups 10-16 were also bled on Days 84 & 112. Mice that survived challenge were also terminally bled on Day 10 post challenge. Serum samples from mice (Days −3, 28, 56, 84, 112 and surviving mice) were kept frozen (−80° C.) and stored until they were tested for reactivity in a semi quantitative ELISA for mouse IgG against either E1, E2 or CHIKV lysate.

Experimental Procedure

Intramuscular (IM) Injection of Mice

1. Restrain the animal either manually, chemically, or with a restraint device.

2. Insert the needle into the muscle. Pull back slightly on the plunger of the syringe to check proper needle placement. If blood is aspirated, redirect the needle and recheck placement again.

3. Inject appropriate dose and withdraw needle. Do not exceed maximum volume. If the required volume exceeds the maximum volume allowed, multiple sites may be used with each receiving no more than the maximum volume.

4. The injection site may be massaged gently to disperse the injected material.

Intradermal (ID) Injections of Mice

1. Restrain the animal either manually, chemically, or with a restraint device.

2. Carefully clip the hair from the intended injection site. This procedure can be done upon animals arriving or the day before any procedures or treatments are required.

3. Lumbar area is the most common site for ID injections in all species, but other areas can be used as well.

4. Pinch or stretch the skin between your fingers (or tweezers) to isolate the injection site.

5. With the beveled edge facing up, insert the needle just under the surface between the layers of skin. Inject the appropriate dose and withdraw needle. A small bleb will form when an ID injection is given properly.

6. If the required volume exceeds the maximum volume allowed, multiple sites may be used with each receiving no more than the maximum volume.

Retro-Orbital Bleeding in Mice

1. Place the mice in the anesthesia chamber and open oxygen line and set to 2.5% purge. Start flow of anesthesia at 5% isoflurane.

2. Once the animal becomes sedate, turn anesthesia to 2.5%-3% isoflurane and continue to expose the animal to the anesthesia. Monitor the animal to avoid breathing becoming slow.

3. Remove the small rodent from anesthesia chamber and place on its back while restraining with left hand and scruff the back of the animal's neck, so it is easy to restrain and manipulate while performing the procedure with the right hand.

4. With a small motion movement, place the capillary tube in the corner of the animal's eye close to the nostril, and rotate or spin the Hematocrit glass pipette until blood start flowing out. Collect the appropriate amount of blood needed into the appropriate labeled vial.

5. Monitor the animal after retro-orbital bleeding is done for at least 10-15 seconds to ensure hemostasis.

6. Place the animal back to its original cage and monitor for any other problems or issues caused while manipulating animal due to the procedure.

Observation of Mice 1. Mice were observed through 10 days post infection (11 days total, 0-10 days post infection).

2. Mice were weighed daily on an Ohause scale and the weights are recorded.

3. Survival and health of each mouse were evaluated once time a day using a scoring system of 1-7 described in Table 5.

Infection

On either Day 56 (Groups 1-4, 7-9) or Day 112 (Groups 10-16) groups of 5 female 6-8 week old AG129 mice were infected via intradermal injection with $1\times10^4$ PFU/mouse of the 181/25 strain of Chikungunya diluted in PBS. The total inoculation volume was 0.05 mL administered in the rear footpad of each animal. Mice were anesthetized lightly using 2-5% v/v of isoflurane at ~2.5 L/min of 02 (VetEquip IMPAC6) immediately prior to infection.

Dose Administration

In this study mice were administered 0.04 μg, 2 μg, or 10 μg of various formulations of the CHIKV vaccine X or vehicle alone (PBS) on either Day 0 or on Days 0 and 28 via the intramuscular route (0.05 mL). The material was pre-formulated by the Client and diluted in PBS by IBT prior to dosing as per instructions provided by the Client.

Results

Figure 42A:
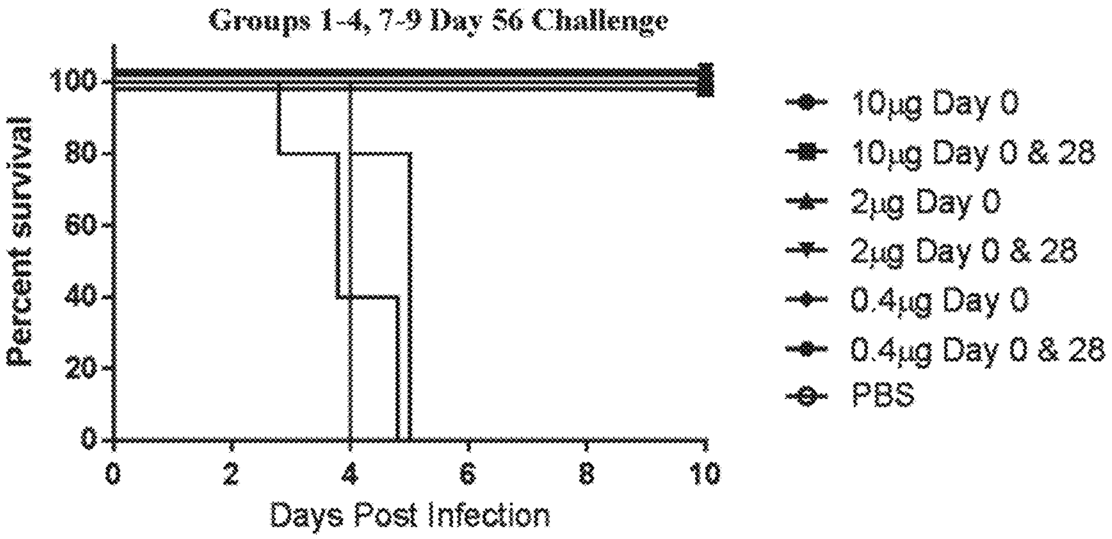
FIGS. 42A-42B are graphs showing the survival curves from a CHIKV challenge study in AG129 mice immunized with CHIKV mRNA vaccines in 10 μg, 2 μg, or 0.04 μg doses. Mice were divided into 14 groups (1-4 and 7-16, n=5).
Figure 42B:
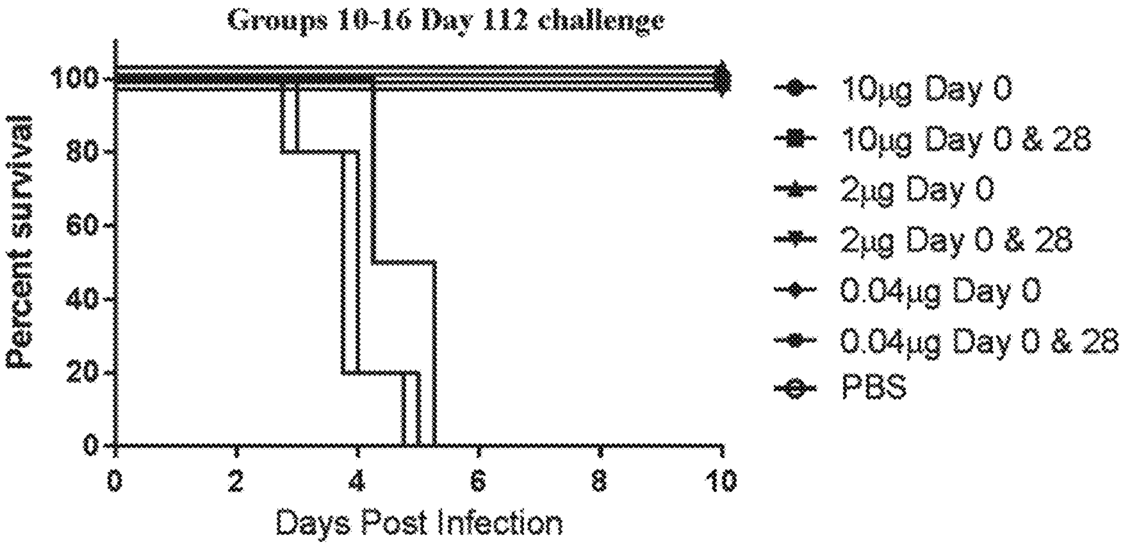
Figure 43A:
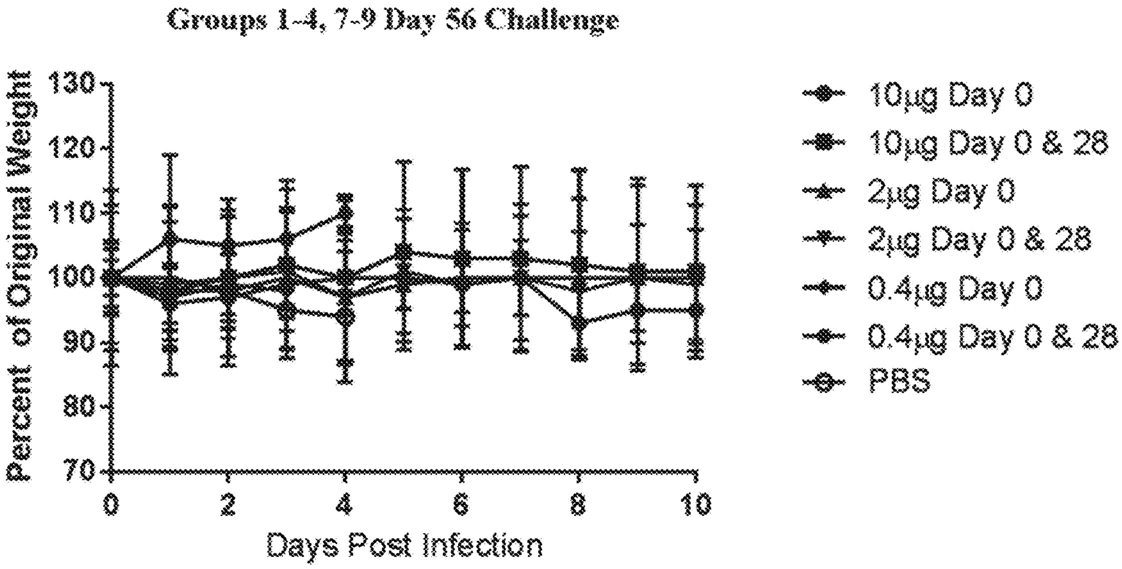
FIGS. 43A-43B are graphs showing the weight changes post challenge in AG129 mice immunized with CHIKV mRNA vaccines.
Figure 43B:
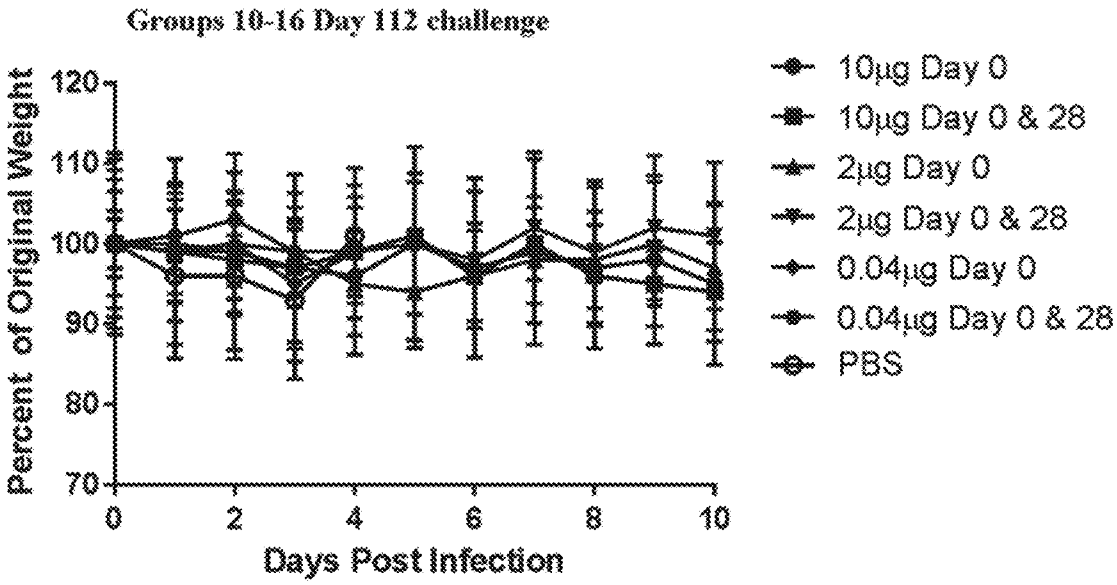
Figure 44A:
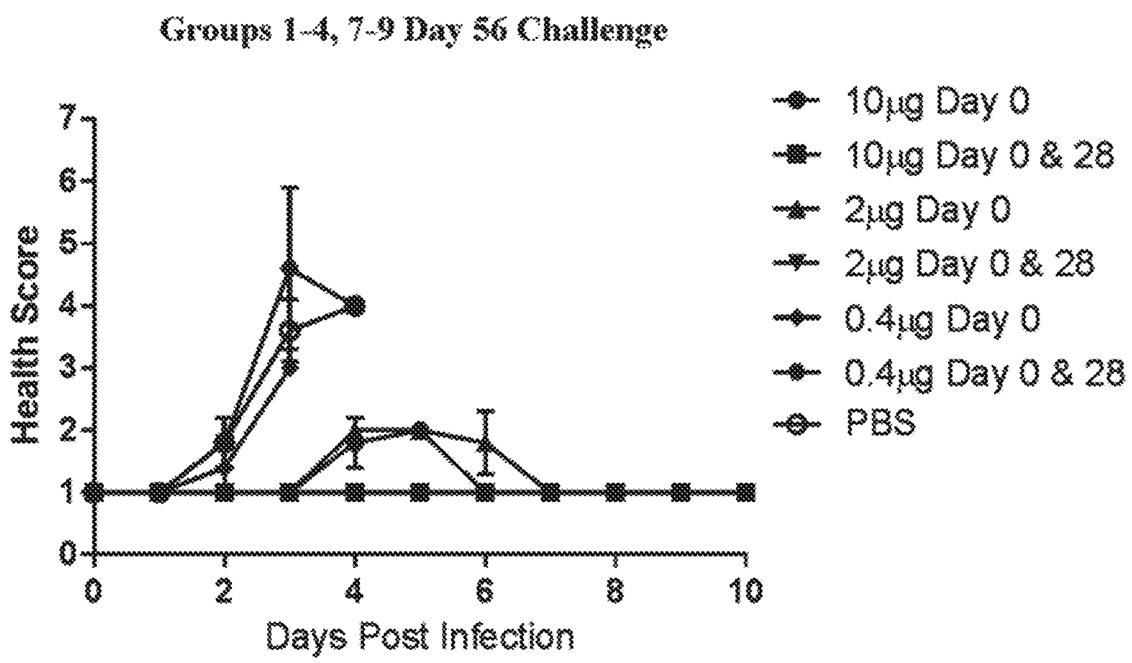
FIGS. 44A-44B are graphs showing the post challenge heath scores of AG129 mice immunized with CHIKV mRNA vaccines.
Figure 44B:
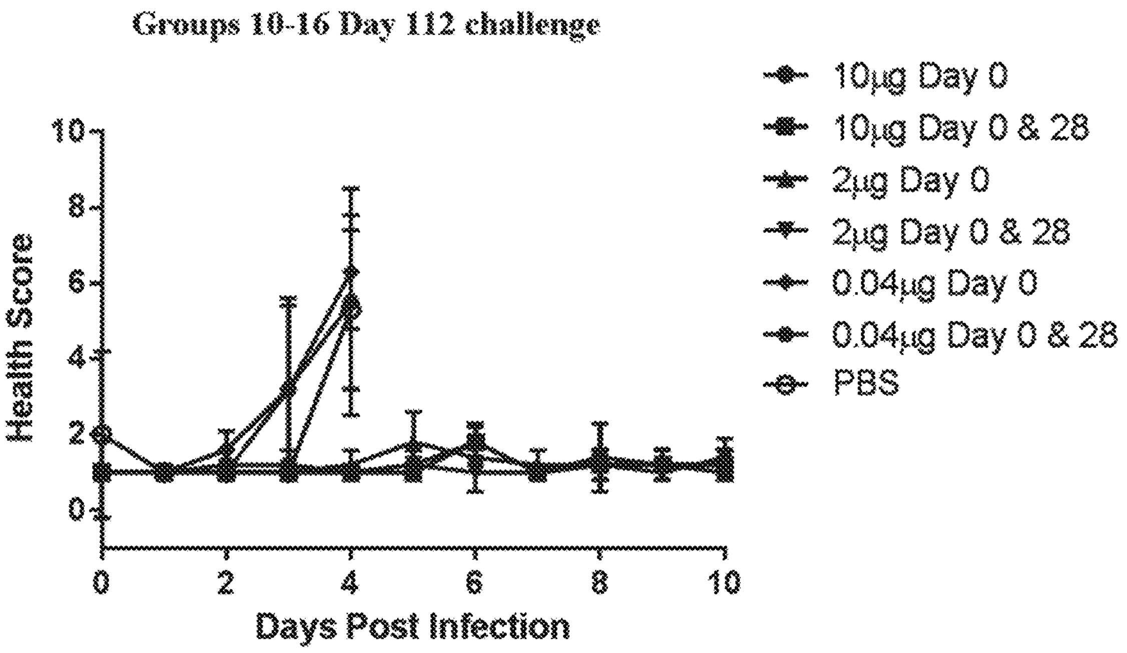
Figure 45A:
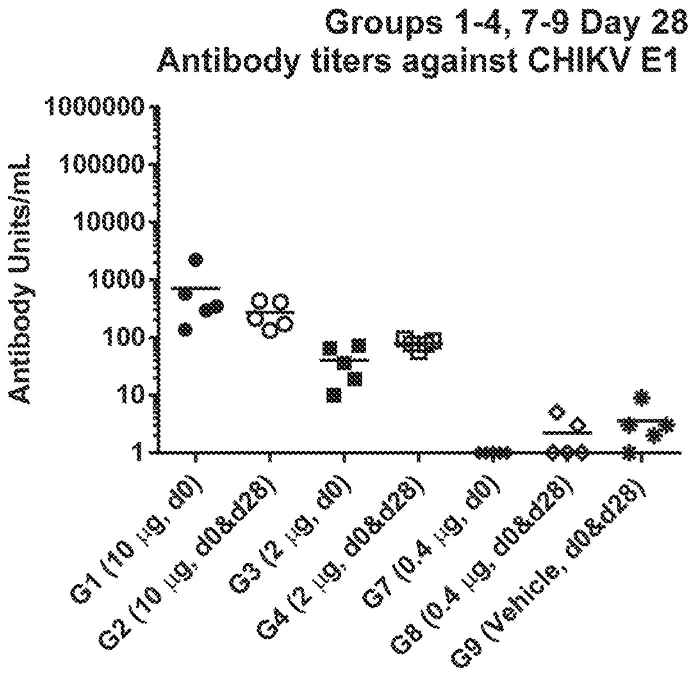
FIGS. 45A-45C are graphs showing the antibody titers measured by ELISA assays in the serum of AG129 mice (groups 1-4 and 7-9) 28 days post immunization with CHIKV mRNA vaccines.
Figure 45B:
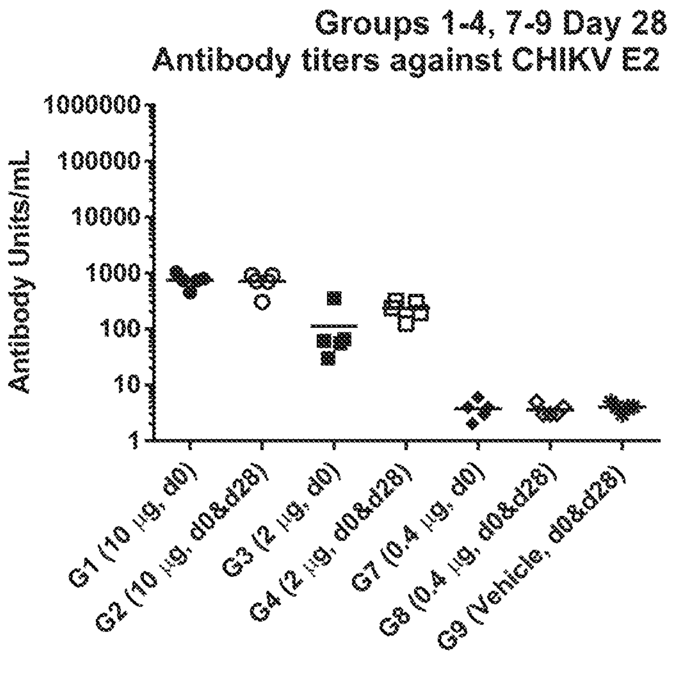
Figure 45C:
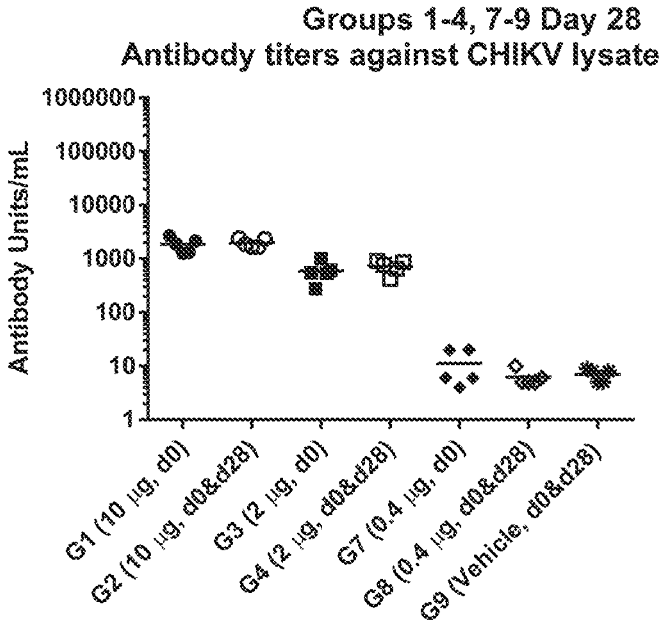
Figure 46A:
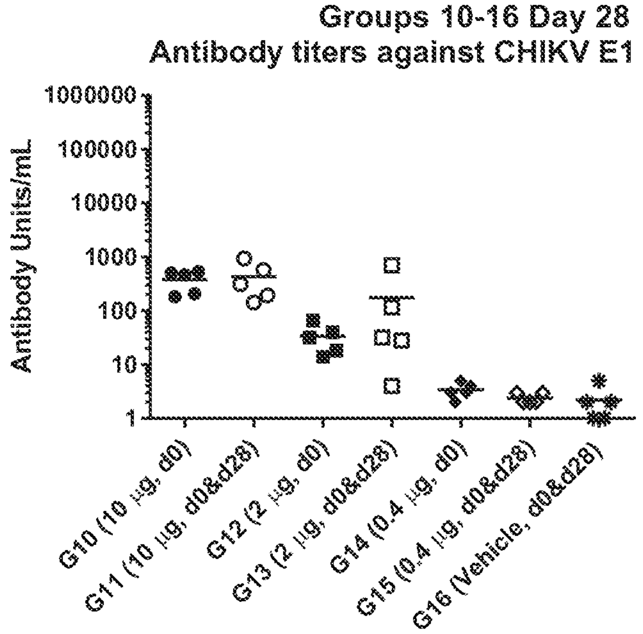
FIGS. 46A-46C are graphs showing the antibody titers measured by ELISA assays in the serum of AG129 mice (groups 10-16) 28 days post immunization with CHIKV mRNA vaccine.
Figure 46B:
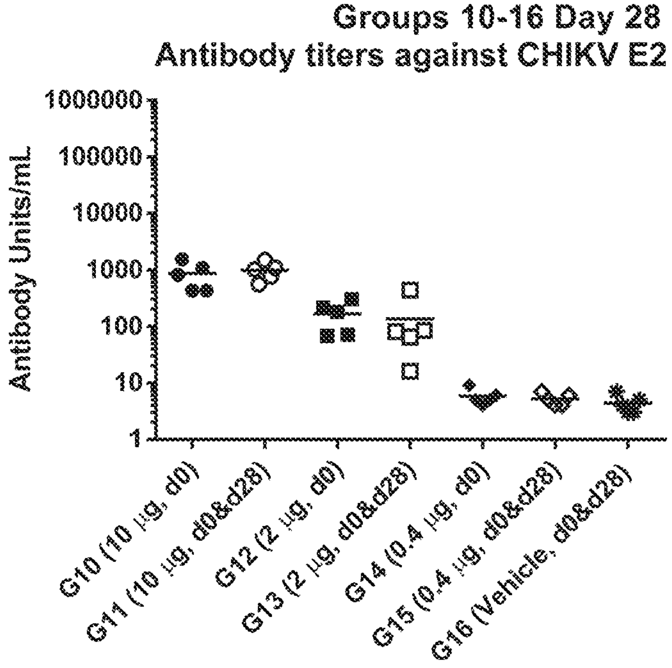
Figure 46C:
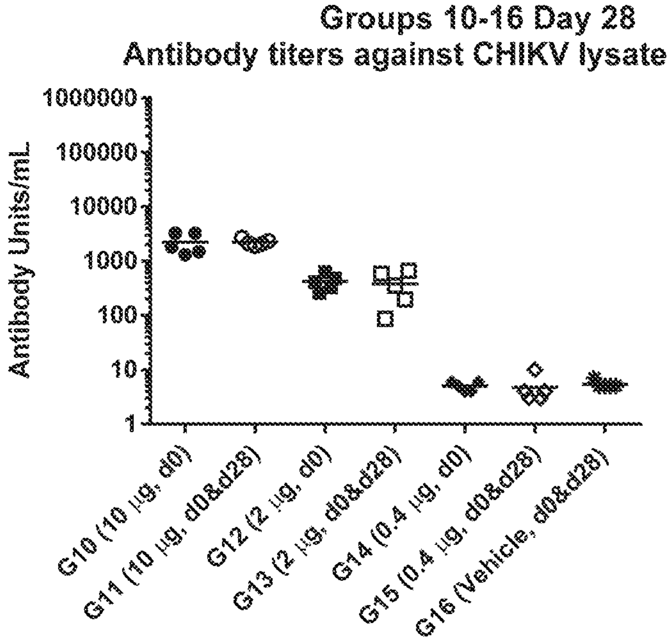

Mice were immunized once (Day 0) or twice (Days 0 & 28) with either 0.04 μg, 2 μg, or 10 μg of Chikungunya vaccine X and were challenged with CHIKV strain 181/25 on either Day 56 (Groups 1-4, 7-9) or on Day 112 (Groups 10-16). Mice were monitored for a total of 10 days post infection for health and weight changes. Mice that received either 2 μg or 10 μg of the CHIKV vaccine X either once (Day 0) or twice (Days 0 and 28) were fully protected (100%) regardless of whether the mice were challenged 56 days or 112 days after the initial vaccination (FIGS. 42A-42B, Table 44). Mice receiving 0.04 μg of the CHIKV vaccine were not protected at all from lethal CHIKV infection. This efficacy data is supported by the health scores observed in the vaccinated mice in that the protected mice displayed little to no adverse health effects of a CHIKV infection (FIGS. 44A-44B). Weight loss is not a strong indicator of disease progression in the CHIKV AG129 mouse model (FIGS. 43A-43B).

Figure 47A:
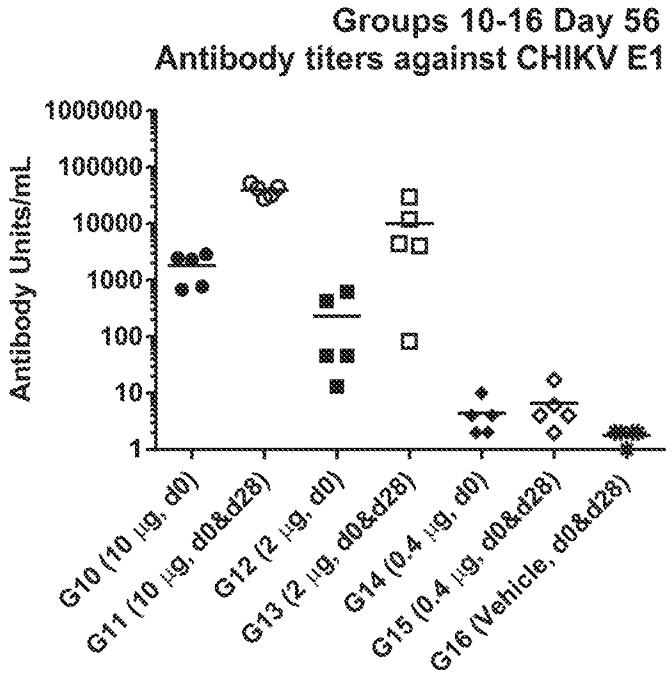
FIGS. 47A-47C are graphs showing the antibody titers measured by ELISA assays in the serum of AG129 mice (groups 10-16) 56 days post immunization with CHIKV mRNA vaccine.
Figure 47B:
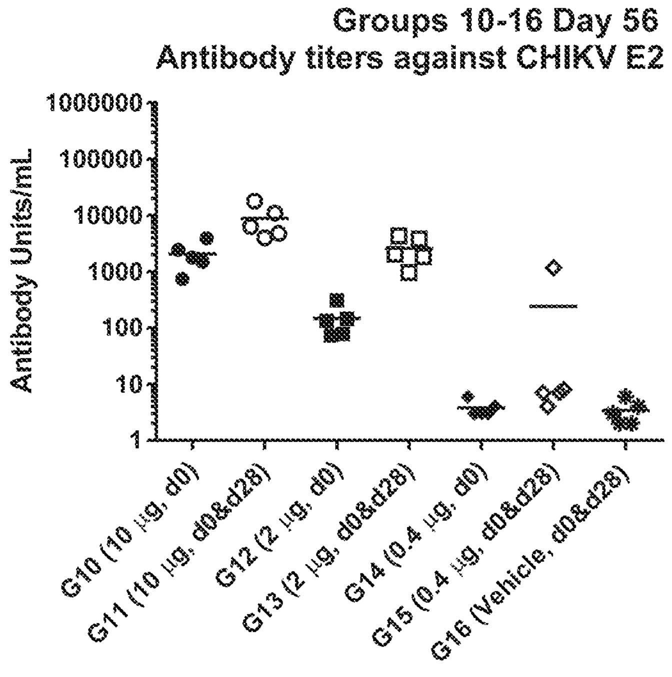
Figure 47C:
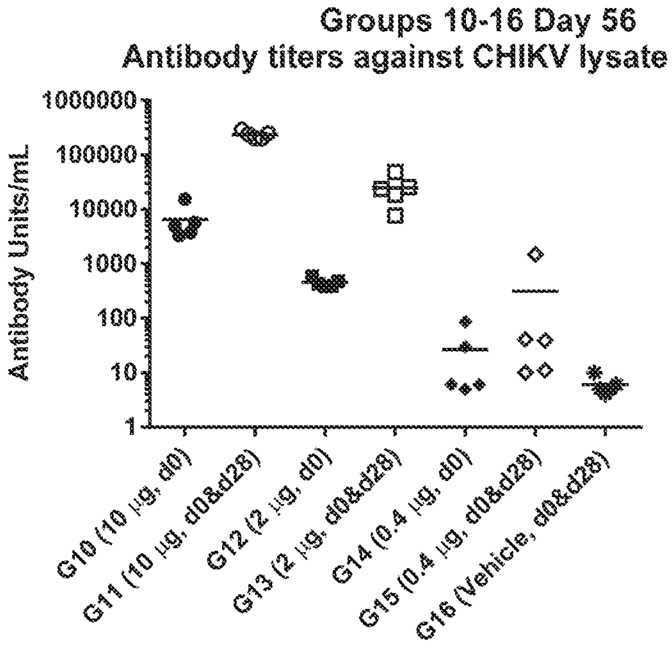
Figure 48A:
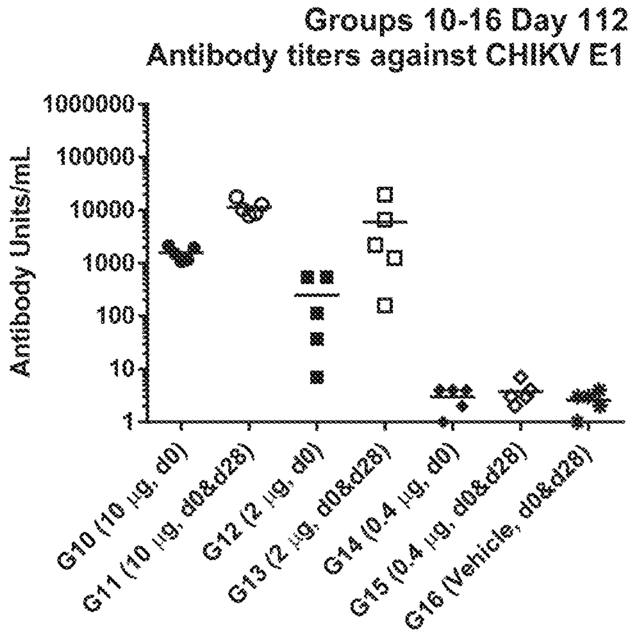
FIGS. 48A-48C are graphs showing the antibody titers measured by ELISA assays in the serum of AG129 mice (groups 10-16) 112 days post immunization with CHIKV mRNA vaccine.
Figure 48B:
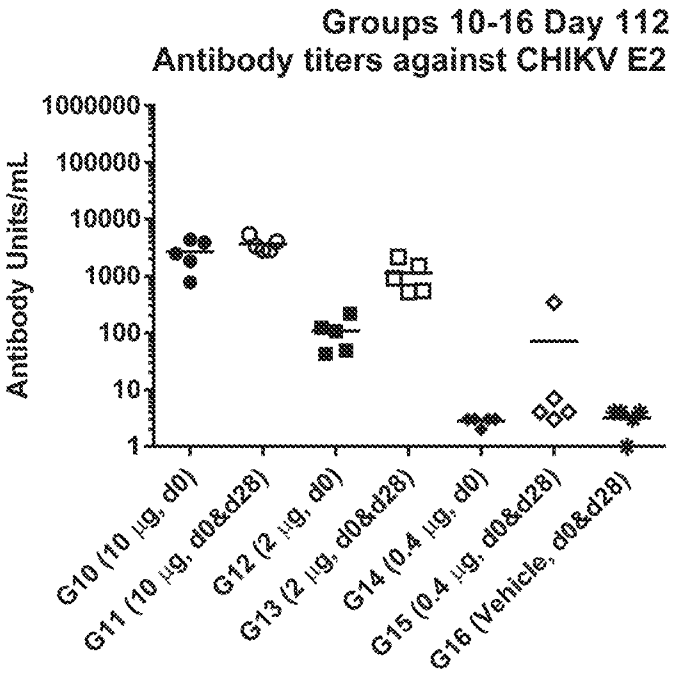
Figure 48C:
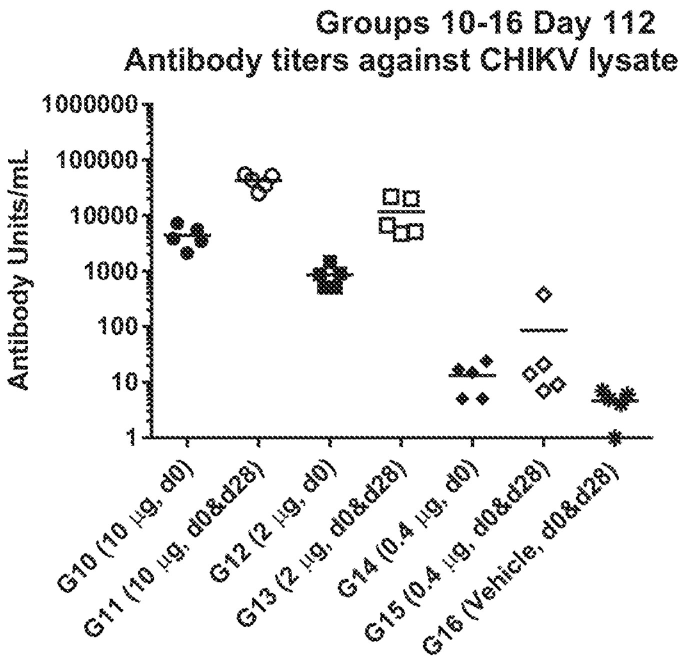
Figure 49:
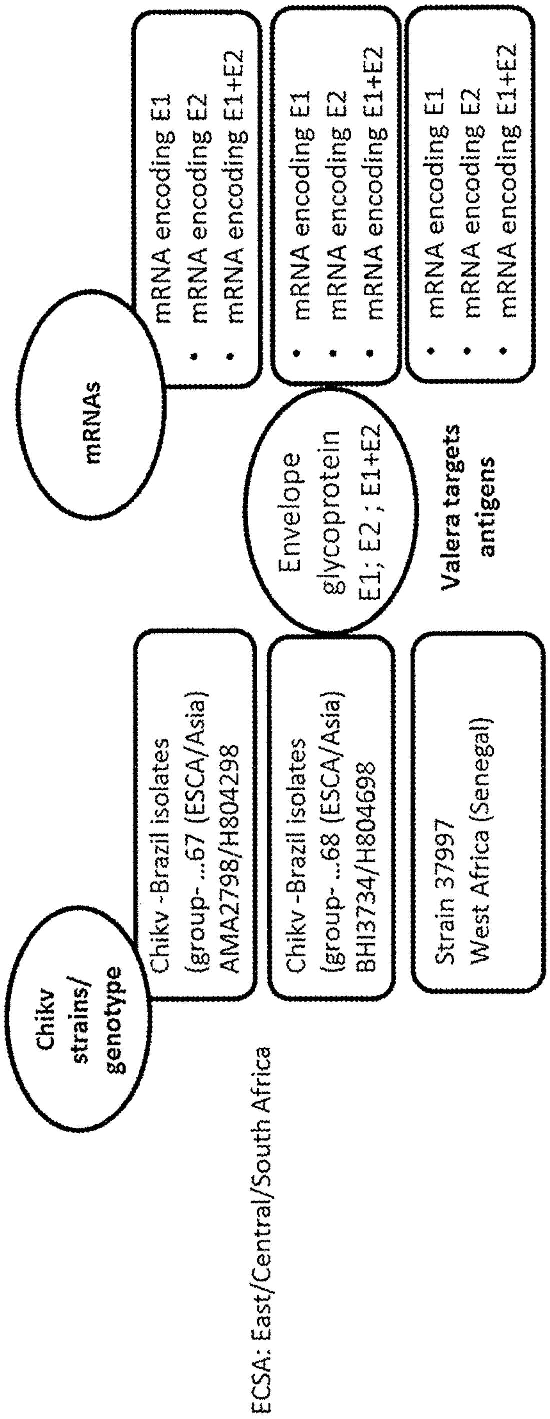
FIG. 49 shows different antigens based on the Chikungunya structural protein from three different genotypes.

Mice immunized with the CHIKV vaccine X showed increased antibody titers against CHIKV E1, E2 and CHIKV lysate as compared to the vehicle only (PBS) treated groups. Serum binding against the virus lysate yielded the highest antibody titers for all vaccinated groups (FIGS. 45A-45C, 46A-46C, 47A-47C, 48A-48C). Overall, the antibody titers were dose dependent with the highest titers observed in serum from mice vaccinated with 10 μg of CHIKV vaccine X while the lowest titers were observed in serum from mice vaccinated with 0.04 μg of the CHIKV vaccine X. Similarly, higher titers were observed in serum from mice vaccinated twice (Days 0 and 28) as compared to serum from mice vaccinated only once (Day 0). Serum obtained on Day 112 post initial vaccination still yielded increased antibody titers in mice that received either 10 μg or 2 μg of CHIKV vaccine X (FIGS. 47A-47C).

Serum from mice groups 10-16, 112 days post immunization were also tested in a Plaque Reduction Neutralization Test (PRNT). Serum from each mice was diluted from 1/20 to 1/40960 and assessed for its ability to reduce CHIKV plaque formation. The results were shown in Table 46.

TABLE 41

CHIKV Challenge Study Design in AG129 mice

| Group* (n = 5) | Vaccine | Schedule | Dose (IM route) | Challenge | Bleeds |
|---|---|---|---|---|---|
| 1 | VAL-181388 | Day 0 | 10 μg | Challenge with $1\times10^4$ PFU per mouse of CHIK 181/25 via ID injection on day 56. | Pre-bleed for serum via RO route on days −3, 28, 56, (all groups) & 84, 112 (groups 10-16 |
| 2 | | Day 0 & 28 | | | |
| 3 | | Day 0 | 2 μg | | |
| 4 | | Day 0 & 28 | | | |

TABLE 41-continued

CHIKV Challenge Study Design in AG129 mice

| Group* (n = 5) | Vaccine | Schedule | Dose (IM route) | Challenge | Bleeds |
|---|---|---|---|---|---|
| 7 | | Day 0 | 0-4 μg | Weights and health for 10 days following infection. | only). Terminal bleed surviving mice on day 10 post challenge. Serum stored at −80° C. |
| 8 | | Day 0 & 28 | | | |
| 9 | PBS | Day 0 & 28 | — | | |
| 10 | VAL-181388 | Day 0 | 10 μg | Challenge with $1 \times 10^4$ PFU per mouse of CHIK 181/25 via ID injection on day 112. Weights and health for 10 days following infection. | |
| 11 | | Day 0 & 28 | | | |
| 12 | | Day 0 | 2 μg | | |
| 13 | | Day 0 & 28 | | | |
| 14 | | Day 0 | 0-4 μg | | |
| 15 | | Day 0 & 28 | | | |
| 16 | PBS | Day 0 & 28 | — | | |

*No group 5 or 6 in this study

TABLE 42

Equipment and Software

| Item | Vendor | Cat#/Model |
|---|---|---|
| Syringes | BD | Various |
| Animal Housing | InnoVive | Various |
| Scale | Ohause | AV2101 |
| Prism software | GraphPad | N/A |

TABLE 42-continued

Equipment and Software

| Item | Vendor | Cat#/Model |
|---|---|---|
| Microplate Washer | BioTek | ELx405 |
| Plate reader with SoftMax Pro version 5.4.5 | Molecular Devices | VersaMax |

TABLE 43

ELISA Reagents

| Name | Supplier cat# | Storage Temperature | Notes |
|---|---|---|---|
| DPBS 1X, sterile | Corning 21-031-CM or equivalent | Ambient | For dilution of coating antigen |
| StartingBlock T20 (PBS) Blocking Buffer | Thermo Scientific 37539 | 2-8° C. | For blocking non-specific binding and use as diluent of Standards, unknown test sera and detection antibody |
| SureBlue Reserve TMB Microwell Peroxidase Substrate (1-Component) | KPL 53-00-02 or equivalent | 2-8° C. | N/A |
| DPBS powder, non-sterile | Corning 55-031-PB or equivalent | 2-8° C. | Use deionized water to dissolved DPBS powder from one bottle to a final volume of 10 liters of 1X DPBS |
| TWEEN-20 | Sigma-Aldrich P1379-500ML or equivalent | Ambient | Add 5 mL TWEEN-20 to 10 liters of 1X DPBS and mix well to prepare DPBS + 0.05% TWEEN-20 Wash Buffer for automatic plate washer |

TABLE 44

ELISA Reagents

| Critical Reagent Please note: Coating antigens and standards are stored as single-use aliquots. | | Supplier cat# and/or lot# | Storage Temperature | Assay Parameter |
|---|---|---|---|---|
| Coating antigens | CHIKV recombinant E1 glycoprotein, expressed in 293 mammalian cells IBT's BCA = 0.351 mg/mL | IBT Bioservices, lot 08.11.2015 | −70° C. or below | 400 ng/well |

TABLE 44-continued

| ELISA Reagents | | | | |
|---|---|---|---|---|
| Critical Reagent Please note: Coating antigens and standards are stored as single-use aliquots. | | Supplier cat# and/or lot# | Storage Temperature | Assay Parameter |
| | CHIKV recombinant E2 glycoprotein, expressed in *E. coli* IBT's BCA = 1.291 mg/mL | ImmunoDx, cat# 80002, lot 10MY4 | −70° C. or below | 400 ng/well |
| | CHIKV 181/25 lysate from sucrose-purified viruses, lysed by sonication IBT's BCA = 1.316 mg/mL | IBT Bioservices, lot 11.23.2015 | −70° C. or below | 300 ng/well |
| Standards | Anti-E1 positive control Pooled mouse serum from survivors of BS-1842 group 4 (vaccinated with E1 mRNA 10 µg, ID, LNP on study days 0 and 28) day 66 terminal bleeds (10 days after CHIKV infection) | IBT Bioservices | −70° C. or below | Assigned, 30,812 Antibody Units/mL against E1 protein |
| | Anti-E2 positive control, Pooled mouse serum from survivors of BS-1842 group 8 (vaccinated with E2 mRNA 10 µg, ID, LNP on study days 0 and 28) day 66 terminal bleeds (10 days after CHIKV infection) | IBT Bioservices | −70° C. or below | Assigned, 16912 Antibody Units/mL against E2 protein Assigned 14,200 Antibody Units/mL |
| Detection antibody | Anti-mouse IgG (H + L)-HRP | KPL, cat# 474-1806, lot 140081 | 2-8° C. | 1:6000 dilution |

TABLE 45

| Survival Percentage | | | | | | | |
|---|---|---|---|---|---|---|---|
| Days p.i. | 10 µg Day 0 | 10 µg Day 0 & 28 | 2 µg Day 0 | 2 µg Day 0 & 28 | 0.4 µg Day 0 | 0.4 µg Day 0 & 28 | PBS |
| a. Groups 1-4 and 7-9, Day 56 Challenge | | | | | | | |
| 0 | 100 | 100 | 100 | 100 | 100 | 100 | 100 |
| 3 | | | | | | 80 | |
| 4 | | | | | 0 | 40 | 80 |
| 5 | | | | | | 0 | 0 |
| 10 | 100 | 100 | 100 | 100 | | | |
| b. Groups 10-16, Day 112 Challenge | | | | | | | |
| 0 | 100 | 100 | 100 | 100 | 100 | 100 | 100 |
| 3 | | | | | 80 | 80 | |
| 4 | | | | | 20 | 20 | 50 |
| 5 | | | | | 0 | 0 | 0 |
| 10 | 100 | 100 | 100 | 100 | | | |

TABLE 46

CHIKV Plaque Reduction Neutralization Test (PRNT)
Serum dilutions from 1/20 to 1/40960

| GP# | Vaccination regimen | Expt info CHIKV strain 37997 | sample ID | PRNT80 titer | PRNT50 titer |
|---|---|---|---|---|---|
| 10 | Day 0, IM/10 µg | CHIKV 37997 working stock titer = 780 PFU/ml | 1 | 1/160 | 1/640 |
| | | | 2 | 1/320 | 1/320 |
| | | | 3 | 1/160 | 1/640 |
| | | | 4 | 1/160 | 1/1280 |
| | | | 5 | 1/320 | 1/1280 |
| 11 | Day 0/Day 28, IM/10 µg | | 1 | 1/640 | 1/2560 |
| | | | 2 | 1/1280 | 1/1280 |
| | | | 3 | 1/320 | 1/2560 |
| | | | 4 | 1/640 | 1/5120 |
| | | | 5 | 1/1280 | 1/5120 |
| 12 | Day 0, IM/2 µg | | 1 | 1/20 | 1/80 |
| | | | 2 | 1/40 | 1/320 |
| | | | 3 | <1/20 | 1/160 |
| | | PRNT80 | 4 | <1/20 | 1/160 |
| | | cutoff | 5 | <1/20 | 1/20 |

TABLE 46-continued

CHIKV Plaque Reduction Neutralization Test (PRNT)
Serum dilutions from 1/20 to 1/40960

| GP# | Vaccination regimen | Expt info CHIKV strain 37997 | sample ID | PRNT80 titer | PRNT50 titer |
|---|---|---|---|---|---|
| 13 | Day 0, Day 28, IM/2 µg | 8 PFU | 1 | 1/80 | 1/320 |
| | | | 2 | 1/80 | 1/640 |
| | | | 3 | 1/20 | 1/320 |
| | | | 4 | 1/20 | 1/320 |
| | | | 5 | 1/320 | 1/640 |
| 14 | Day 0, IM/0.4 µg | | 1 | <1/20 | 80 |
| | | | 2 | <1/20 | <1/20 |
| | | | 3 | <1/20 | <1/20 |
| | | | 4 | <1/20 | <1/20 |
| | | | 5 | <1/20 | <1/20 |
| 15 | Day 0, Day 28, IM/0.4 µg | PRNT50 cutoff 20 PFU | 1 | <1/20 | <1/20 |
| | | | 2 | <1/20 | 80 |
| | | | 3 | <1/20 | <1/20 |
| | | | 4 | <1/20 | <1/20 |
| | | | 5 | <1/20 | <1/20 |
| 16 | Vehicle Day 0/Day 28 | | 1 | <1/20 | <1/20 |
| | | | 2 | <1/20 | <1/20 |
| | | | 3 | <1/20 | <1/20 |
| | | | 4 | <1/20 | <1/20 |
| | | | 5 | <1/20 | <1/20 |

Figure 58:
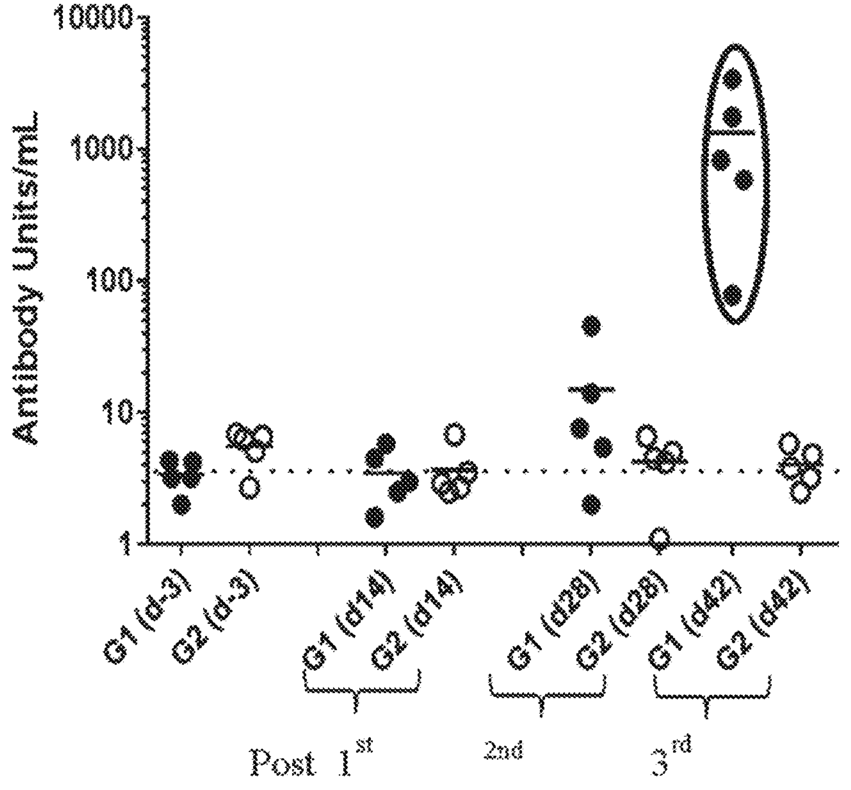
FIG. 58 is a graph depicting antibody titer against CHIKV lysate post 3rd vaccination 10 with the mRNA vaccine in Sprague Dawley rats.

Example 43: Immunogenicity of Chikungunya Polyprotein (C-E3-E2-6K-E1) mRNA Vaccine Candidate in Rats Sprague Dawley rats (n=5) were vaccinated with 20 µg of MC-3-LNP formulated mRNA 30 encoded CHIKV polyprotein (C-E3-E2-6K-E1) (SEQ ID NO: 13). The rats were vaccinated on either Day 0 or Days 0 and 14 or Days 0, 14 and 28 via IM delivery. Sera was collected on days −3, 14, 28 and 42 for ELISA testing. FIG. 58 demonstrated that there was at least a two log increase in antibody titer against CHIKV lysate post 3rd vaccination with the mRNA vaccine in normal rats.

Example 44: Evaluation of T Cell Activation of Chikungunya P 5 Polyprotein (C-E3-E2-6K-E1) mRNA Vaccine Candidate C57BL/6 mice (n=6 experimental group; n=3 control group) were vaccinated with 10 μg of MC-3-LNP formulated mRNA encoded CHIKV polyprotein (C-E3-E2-6K-E1) (SEQ ID NO: 13). The mice were vaccinated on either Day 0 or Days 0 and 28 (boost) via IM delivery. Sera was collected on days 3, 28 and 42 for ELISA testing. Animals were sacrificed on day 42 and spleens were harvested for immunological evaluation of T cells. Splenic cells were isolated and analyzed by FACS. Briefly, spleens were removed, cells isolated, and stimulated in vitro with immunogenic peptides found within either C, E1, or E2 region of CHIKV that are known to be CD8 epitopes in B6 mice. The readout for this assay was cytokine secretion (IFN-gamma and TNF-alpha), which reveals whether the vaccine induced antigen-specific T cell responses. No CD8 T cell responses were detected using the E2 or C peptide (baseline levels of IFN-gamma and TNF-alpha), whereas there was a response to the E1-corresponding peptide (average of about 0.4% IFN-gamma and 0.1% TNF). The peptides were used to stimulate T cells used in the study were E1=HSMTNAVTI (SEQ ID NO: 300), E2=IILYYYELY (SEQ ID NO: 301), and C=ACLVGDKVM (SEQ ID NO: 302).

Figure 59:
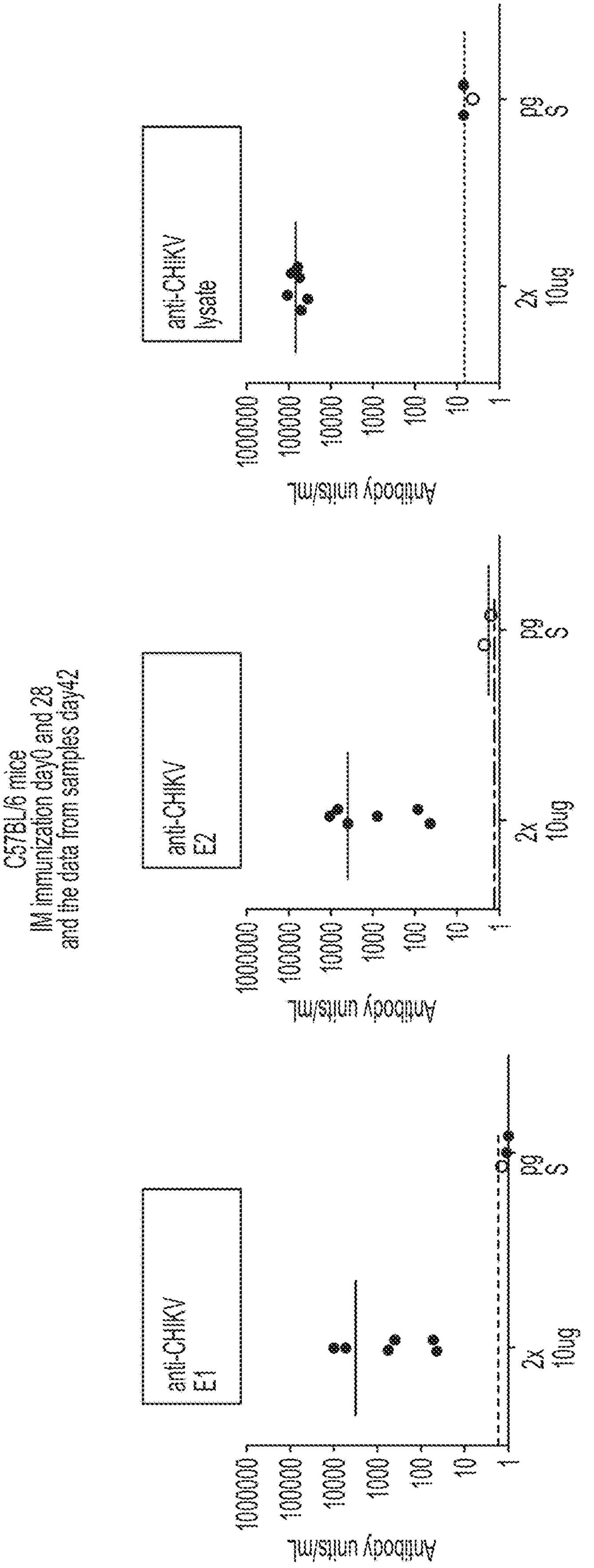
FIG. 59 shows a set of graphs depicting antibody titers following vaccination of mice with mRNA encoded CHIKV polyprotein (C-E3-E2-6K-E1).
Figure 60:
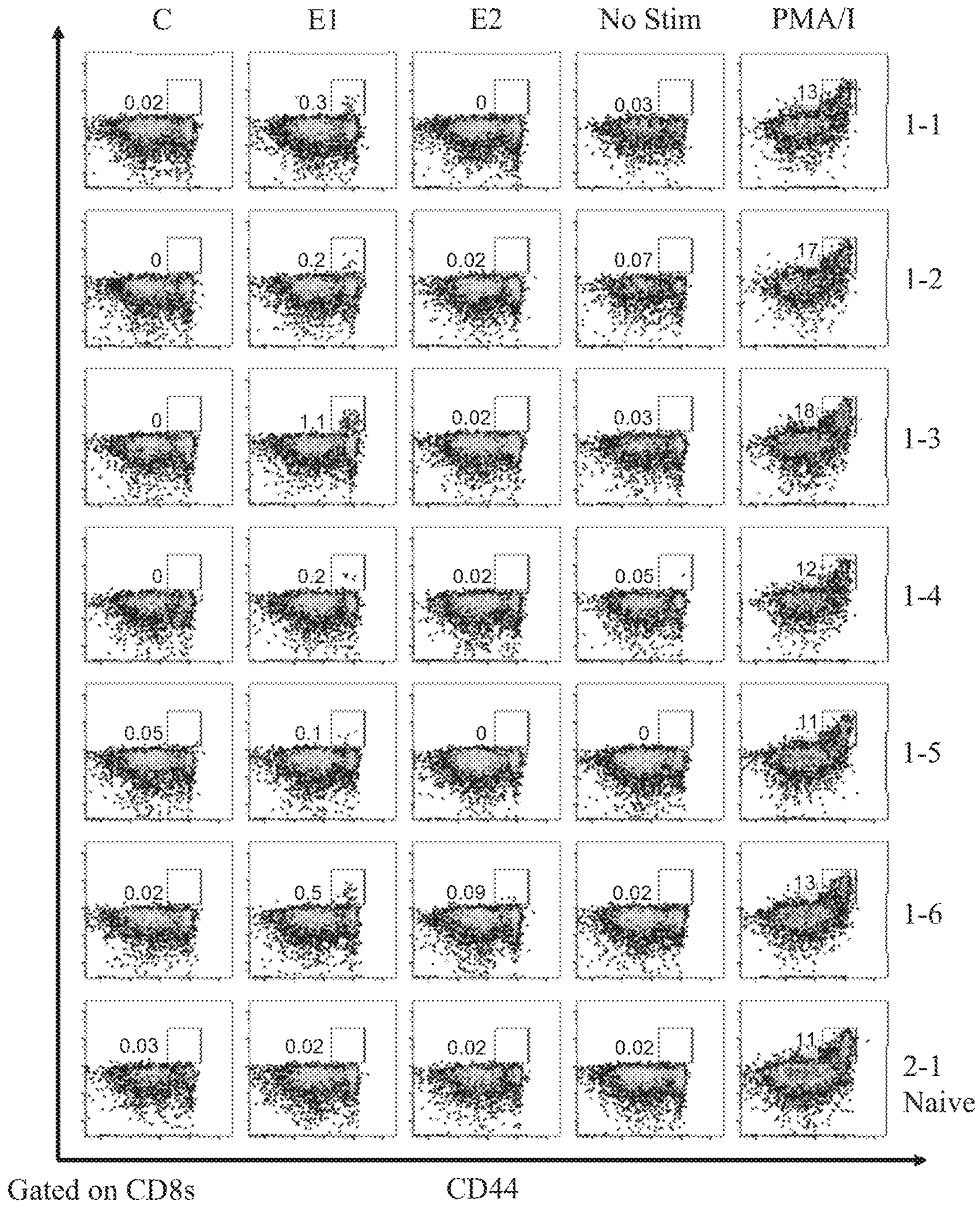
FIG. 60 shows a set of plots depicting cytokine secretion and T-cell activation following vaccination of mice with mRNA encoded CHIKV polyprotein (C-E3-E2-6K-E1) (SEQ ID NO: 13).
Figure 60:
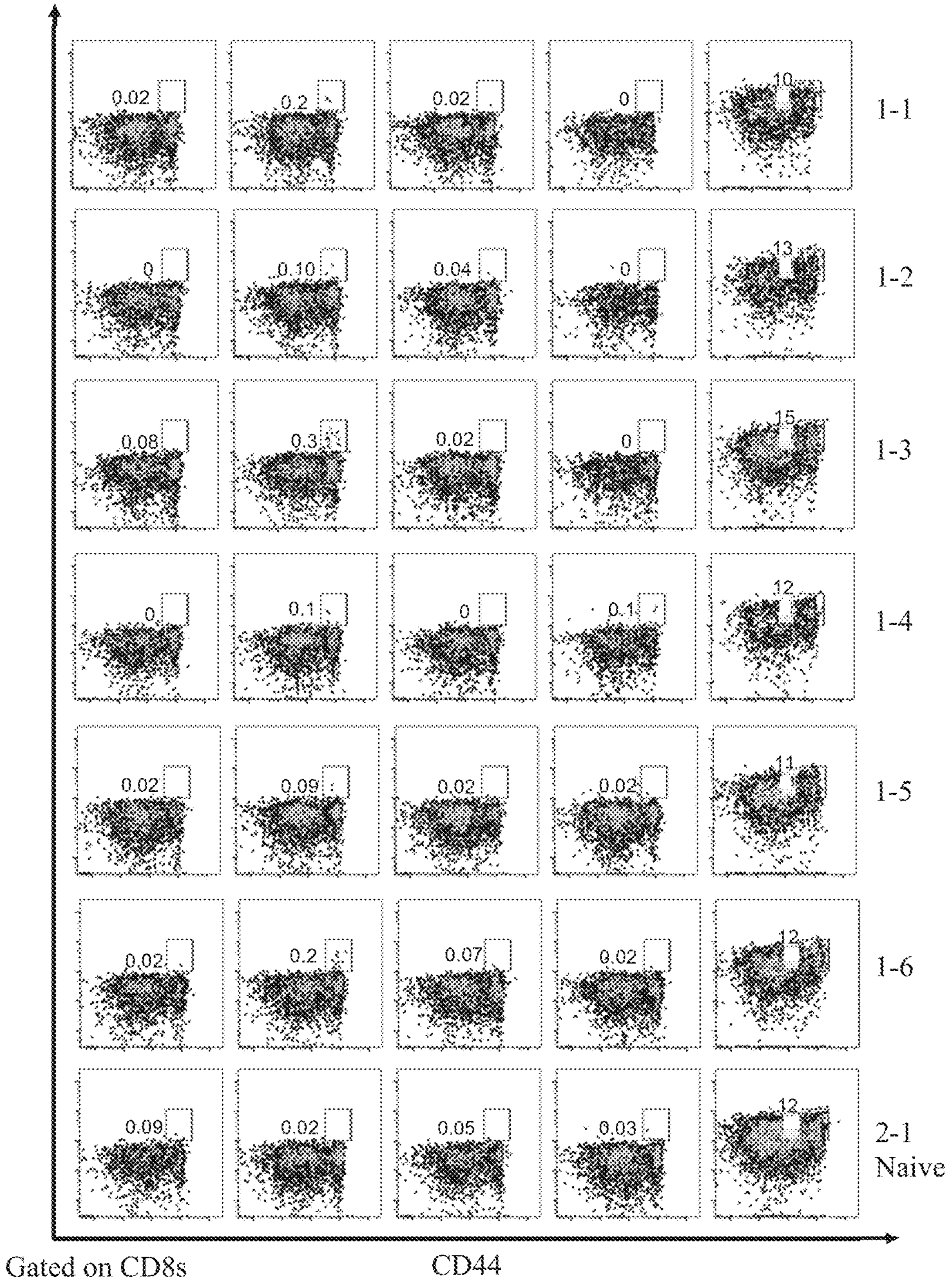
Figure 61A:
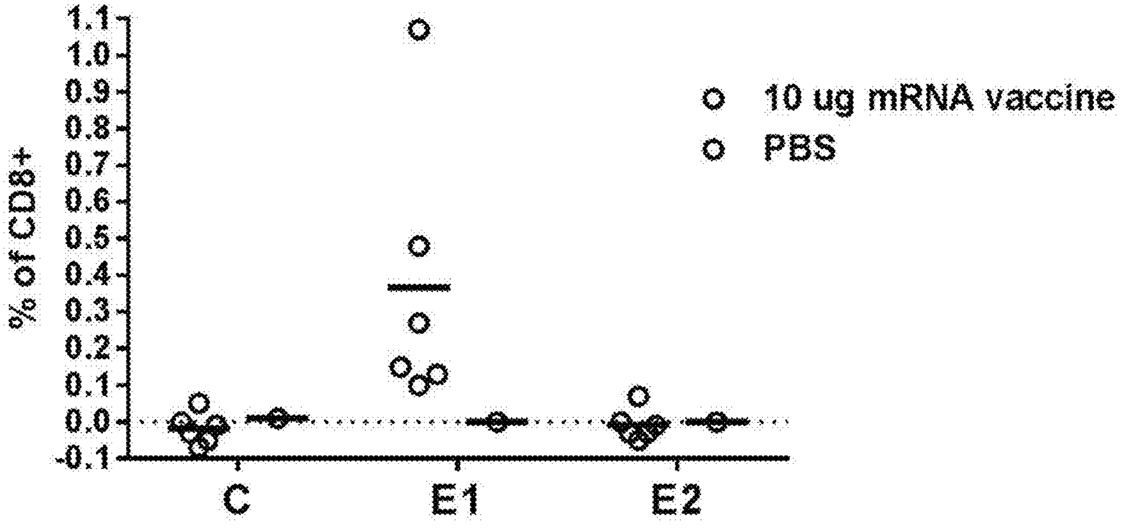
FIGS. 61A-61B show a set of graphs depicting CD8+ T cell activation following vaccination of mice with mRNA encoded CHIKV polyprotein (C-E3-E2-6K-E1) (SEQ ID NO: 13).
Figure 61B:
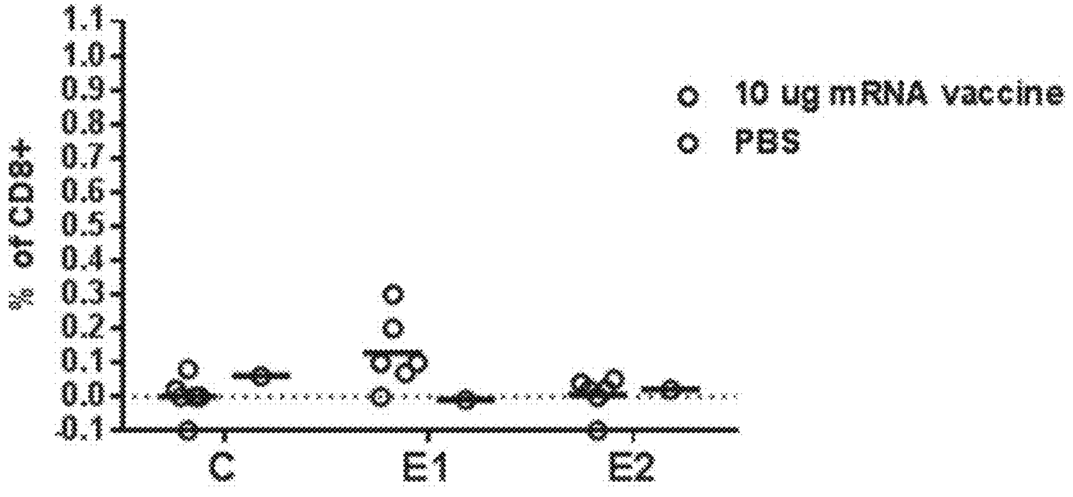

FIG. 59 shows that the polyprotein-encoding CHIKV polyprotein vaccine elicited high antibody titers against the CHIKV glycoproteins. FIGS. 60 and 61A-61B show T cell activation by E1 peptide.

EQUIVALENTS

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

It should also be understood that, unless clearly indicated to the contrary, in any methods claimed herein that include more than one step or act, the order of the steps or acts of the method is not necessarily limited to the order in which the steps or acts of the method are recited.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03.

SEQUENCE LISTING (326 sequences)

SEQ ID NO: 1 - DNA, 1537 bp, Chikungunya virus
tcaagcttttggaccctcgtacagaagctaatacgactcactatagggaaataagagagaaaagaagagtaagaagaaatataagagccaccatggagacacctgcacagctgttgtttctgctgctgctttggttgcccgataccaccggtgactacaaagacgacgacgataaatacgagcacgtgacggtaataccaaacactgtgggggtgccatacaagaccctggtaaatcgcccaggctactctcccatggtgctggagatggagctccagtctgtgaccttagagccaaccctctcactcgactatatcacctgtgaatacaaaacagtgatcccatccccctacgtgaaatgttgcggaactgcagagtgtaaggataagagtctgcccgattacagctgcaaggtgtttacaggcgtgtatccatttatgtggggaggagcctactgtttttgcgatgccgaaaatactcagctgtctgaagcccatgtggagaagagtgaaagttgcaagaccgaatttgctagtgcctacagggcacacaccgcttctgcctccgctaaactccgagtcctttaccagggcaataatattacggtcgctgcctacgctaacggggaccacgctgtgacagtcaaggacgccaaattcgtagtgggcccaatgagctccgcctggactcccttcgacaacaaaatcgtcgtgtataaaggcgacgtgtacaatatggactacccacccttcggggctggaagaccgggccagtttggagatatccaatcaaggacacccgagtcaaaggacgtgtacgccaatacgcagctggtgctgcagagacccgccgctggtaccgtgcatgtgccttattcccaagctccatctggcttcaagtactggttgaaagagcgcggtgcttcgctgcagcatacagcaccgttcggatgtcagatagcaaccaaccctgtacgggctgtcaactgtgccgtgggaaatatacctatttccatcgacattccggacgcagctttcacacgtgtcgttgatgccccctcagtgactgacatgtcatgtgaggtgcctgcttgcacccacagcagcgattttggcggagtggccataatcaagtacaccgcctccaaaaaaggaaagtgtgccgtacactctatgaccaacgccgtcacaatcagagaagccgacgttgaagtagagggaaattcacagctgcaaatcagcttcagcaccgctcttgcctctgctgagtttagggttcaggtttgcagtactcaggtgcactgtgcagccgcttgccatccccccaaggatcatatcgtgaattatcctgcatcccacaccacactgggagtccaggatatctcaacaactgcaatgtcttgggtgcagaagatcacctgataataggctggagcctcggtggccatgcttcttgccccttgggcctccccccagcccctcctccccttcctgcacccgtacccccgtggtctttgaataaagtctgagtgggcggc

SEQ ID NO: 2 - DNA, 1531 bp, Chikungunya virus
tcaagcttttggaccctcgtacagaagctaatacgactcactatagggaaataagagagaaaagaagagtaagaagaaatataagagccaccatgtacgaacacgtaacagtgatcccgaacacggtgggagtaccgtataagactctagtcaacagaccgggctacagccccatggtattggagatggagcttctgtctgtcaccttggaaccaacgctatcgcttgattacatcacgtgcgagtataaaaccgttatcccgtctccgtacgtgaaatgctgcggtacagcagagtgtaaggacaagagcctacctgattacagctgtaaggtcttcaccggcgtctacccattcatgtggggcggcgcctactgcttctgcgacaccgaaaatacgcaattgagcgaagcacatgtggagaagtccgaatcatgcaaaacagaatttgcatcagcatacagggctcataccgcatccgcatcagctaagctccgcgtcctttaccaaggaaataatatcactgtggctgcttatgcaaacggcgaccatgccgtcacagttaaggacgctaaattcatagtggggccaatgtcttcagcctggacacctttcgacaataaaatcgtggtgtacaaaggcgacgtctacaacatggactacccgcccttcggcgcaggaagaccaggacaatttggcgacatccaaagtcgcacgcctgagagcgaagacgtctatgctaatacacaactggtactgcagagaccgtccgcgggtacggtgcacgtgccgtactctcaggcaccatctggcttcaagtattggctaaaagaacgaggggcgtcgctgcagcacacagcaccatttggctgtcaaatagcaacaaacccggtaagagcgatgaactgcgccgtagggaacatgcctatctccatcgacataccggacgcggcctttaccagggtcgtcgacgcgccatctttaacggacatgtcgtgtgaggtatcagcctgcacccattcctcagactttgggggcgtagccatcattaaatatgcagccagtaagaaaggcaagtgtgcagtgcactcgatgactaacgccgtcactattcgggaagctgaaatagaagtagaagggaactctcagttgcaaatctctttttcgacggccctagccagcgccgaatttcgcgtacaagtctgttctacacaagtacactgtgcagccgagtgccatccaccgaaagaccatatagtcaattacccggcgtcacacaccaccctcggggtccaagacatttccgctacggcgatgtcatgggtgcagaagatcacgggaggtgtgggactggttgtcgctgttgcagcactgatcctaatcgtggtgctatgcgtgtcgtttagcaggcactgataataggctggagcctcggtggccatgcttcttgccccttgggcctccccccagcccctcctccccttcctgcacccgtacccccgtggtctttgaataaagtctgagtgggcggc

SEQ ID NO: 3 - DNA, 1690 bp, Chikungunya virus
tcaagcttttggaccctcgtacagaagctaatacgactcactatagggaaataagagagaaaagaagagtaagaagaaatataagagccaccatgctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaatgataataggctggagcctcggtggccatgcttcttgccccttgggcctccccccagcccctcctccccttcctgcacccgtacccccgtggtctttgaataaagtctgagtgggcggc

SEQ ID NO: 4 - DNA, 1531 bp, Chikungunya virus
tcaagcttttggaccctcgtacagaagctaatacgactcactatagggaaataagagagaaaagaagagtaagaagaaatataagagccaccatgtacgaacacgtaacagtgatcccgaacacggtgggagtaccgtataagactctagtcaatagaccgggctacagtcccatggtattggagatggaactactgtcagtcactttggagccaacgctatcgcttgattacatcacgtgcgagtacaaaaccgttatcccgtctccgtacgtgaaatgctgcggtacagcagagtgcaaggacaaaaacctacctgactacagctgtaaggtcttcaccggcgtctacccatttatgtggggcggagcctactgcttctgcgacgctgaaaacacgcaattgagcgaagcacacgtggagaagtccgaatcatgcaaaacagaatttgcatcagcatacagggctcataccgcatccgcatcagctaagctccgcgtcctttaccaaggaaataacatcactgtaactgcctatgctaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgcgggtacggtacatgtgccatactctcaggcaccatctggctttaagtattggctaaaagaacgaggggcgtcgctgcagcacacagcaccatttggctgccaaatagcaacaaacccggtaagagcggtgaattgcgccgtagggaacatgcccatctccatcgacataccggatgcggccttcattagggtcgtcgacgcgccctctttaacggacatgtcgtgcgaggtaccagcctgcacccattcctcagatttcgggggcgtcgccattattaaatatgcagccagcaagaaaggcaagtgtgcggtgcattcgatgaccaacgccgtcacaattcgggaagctgagatagaagttgaagggaattctcagctgcaaatctctttctcgacggccttggccagcgccgaattccgcgtacaagtctgttctacacaagtacactgtgtagccgagtgccaccctccgaaggaccacatagtcaattacccggcgtcacataccaccctcggggtccaggacatttccgctacggcgctgtcatgggtgcagaagatcacgggaggcgtgggactggttgtcgctgttgcagcactgattctaatcgtggtgctatgcgtgtcgttcagcaggcactgataataggctggagcctcggtggccatgcttcttgccccttgggcctccccccagcccctcctccccttcctgcacccgtacccccgtggtctttgaataaagtctgagtgggcggc

SEQ ID NO: 5 - DNA, 1340 bp, Chikungunya virus
atggagaccccagctcagcttctgtttcttctccttctatggctgcctgacacgactggacatcaccaccatcatcatagtacaaaagacaatttcaatgtgtacaaggccacccgcccttatttagcacactgtccagattgcggtgaggggcactcctgtcactctcctatcgccttggagcggatccggaatgaggcgaccgatggaacactgaaaatccaggtaagcttgcagattggcatcaagactgacgatagccatgattggaccaaactacggtatatggatagccatacacctgccgatgctgaacgggccggtctgcttgtgagaactagcgctccatgcaccatcacggggacaatgggacattttatcctggctagatgcccaaagggcgaaaccctcaccgtcggattcaccgactcaaggaaaatttctcacacatgtacccatcccttccaccatgagccaccggtgatcgggcgcgaacgcttccacagcaggcctcagcatggaaaagaactgccatgctcgacctatgtacagtccaccgccgctaccgccgaagagatcgaagtgcatatgcctcccgacacacccgaccgaaccctaatgacacaacaatctgggaatgtgaagattacagtcaatggacagactgtgaggtataagtgtaactgcggtggctcaaatgagggcctcaccacaacggataaggtgatcaataactgcaaaattgaccagtgtcacgcggccgtgaccaaccataagaactggcagtacaactcacccttagtgcctaggaacgctgagctgggagatcgcaaggggaagatacacattcccttcccgttggcgaatgtgacctgccgtgtgccaaaagcgagaaatcctaccgtaacatatggcaaaaatcaggtgaccatgttgctctacccggatcacccaactctgctgagctatcggaatatgggacaagaacccaattaccacgaggaatgggttacgcacaagaaagaggtgacccttacagtccctactgaaggtctggaagtgacctggggcaataacgagccttataagtactggccccagatgagtacaaacggcaccgcccatggacatccacacgagatcattctgtattactacgaactatatcccacaatgactggcaagcctataccaaacccacttctcggccttgatagcacatgataataggctggagcctcggtggccatgcttcttgccccttgggcctccccccagcccctcctccccttcctgcacccgtacccccgtggtctttgaataaagtctgagtgggcggc

SEQ ID NO: 6 - DNA, 1483 bp, Chikungunya virus
tcaagcttttggaccctcgtacagaagctaatacgactcactatagggaaataagagagaaaagaagagtaagaagaaatataagagccaccatgagtaccaaggacaacttcaatgtctataaagccacaagaccgtacttagctcactgtcccgactgtggagaagggcactcgtgccatagtcccgtagcattagaacgcatcagaaatgaagcgacagacgggacgctgaaaatccaggtctccttgcaaatcggaataaagacggatgatagccacgattggaccaagctgcgttacatggacaaccacacgccagcggacgcagagagggcggggctatttgtaagaacatcagcaccgtgcacgattactggaacaatgggacacttcatcctgacccgatgtccgaaaggggaaactctgacggtgggattcactgacagtaggaagatcagtcactcatgtacgcacccatttcaccacgaccctcctgtgataggccgggagaaattccattcccgaccgcagcacggtaaagagctgccttgcagcacgtacgtgcagagcaccgccgcaactaccgaggagatagaggtacacatgcccccagacacccctgatcgcacattgatgtcacaacagtccggcaacgtaaagatcacagttaatggccagacggtgcggtacaagtgtaattgcggtggctcaaatgaaggactaataactacagacaaagtgattaataactgcaaagttgatcaatgtcatgccgcggtcaccaatcacaaaaagtggcagtacaactcccctctggtcccgcgtaatgctgaacttggggaccgaaaaggaaaaatccacatcccgtttccgctggcaaatgtaacatgcagggtgcctaaagcaaggaaccccaccgtgacgtacgggaaaaaccaagtcatcatgctactgtatcccgaccacccaacactcctgtcctaccggaacatgggagaagaaccaaactaccaagaagagtgggtgacgcataagaaggaagtcgtgctaaccgtgccgactgaagggctcgaggtcacgtggggtaacaacgagccgtataagtattggccgcagttatctacaaacggtacagcccatggccacccgcatgagataattctgtattattatgagctgtaccctactatgactgtagtagttgtgtcagtggcctcgttcgtactcctgtcgatggtgggtgtggcagtggggatgtgcatgtgtgcacgacgcagatgcatcacaccgtacgaactgacaccaggagctaccgtccctttcctgcttagcctaatatgctgcatcagaacagctaaagcgtgataataggctggagcctcggtggccatgcttcttgccccttgggcctccccccagcccctcctccccttcctgcacccgtacccccgtggtctttgaataaagtctgagtgggcggc

SEQ ID NO: 7 - DNA, 1483 bp, Chikungunya virus
tcaagcttttggaccctcgtacagaagctaatacgactcactatagggaaataagagagaaaagaagagtaagaagaaatataagagccaccatgagtattaaggaccacttcaatgtctataaagccacaagaccgtacctagctcactgtcccgactgtggagaagggcactcgtgccatagtcccgtagcgctagaacgcatcagaaacgaagcgacagacgggacgttgaaaatccaggtttccttgcaaatcggaataaagacggatgatagccatgattggaccaagctgcgttatatggacaatcacatgccagcagacgcagagcgggccgggctatttgtaagaacgtcagcaccgtgcacgattactggaacaatgggacacttcattctggcccgatgtccgaaaggagaaactctgacggtggggttcactgacggtaggaagatcagtcactcatgtacgcacccatttcaccatgaccctcctgtgataggccgggaaaaattccattcccgaccgcagcacggtagggaactaccttgcagcacgtacgcgcagagcaccgctgcaactgccgaggagatagaggtacacatgcccccagacaccccagatcgcacattaatgtcacaacagtccggcaatgtaaagatcacagtcaatagtcagacggtgcggtacaagtgcaattgtggtgactcaagtgaaggattaaccactacagataaagtgattaataactgcaaggtcgatcaatgccatgccgcggtcaccaatcacaaaaaatggcagtataactcccctctggtcccgcgtaatgctgaattcggggaccggaaaggaaaagttcacattccatttcctctggcaaatgtgacatgcagggtgcctaaagcaagaaaccccaccgtgacgtacggaaaaaaccaagtcatcatgttgctgtatcctgaccacccaacgctcctgtcctacaggaatatgggagaagaaccaaactatcaagaagagtgggtgacgcataagaaggagatcaggttaaccgtgccgactgaggggctcgaggtcacgtggggtaacaatgagccgtacaagtattggccgcagttatccacaaacggtacagcccacggccacccgcatgagataattctgtattattatgagctgtacccaactatgactgcggtagttttgtcagtggcctcgttcatactcctgtcgatggtgggtgtggcagtggggatgtgcatgtgtgcacgacgcagatgcattacaccgtacgaactgacaccaggagctaccgtccctttcctgcttagcctaatatgctgcattagaacagctaaagcgtgataataggctggagcctcggtggccatgcttcttgccccttgggcctccccccagcccctcctccccttcctgcacccgtacccccgtggtctttgaataaagtctgagtgggcggc

SEQ ID NO: 8 - DNA, 1426 bp, Chikungunya virus
tcaagcttttggaccctcgtacagaagctaatacgactcactatagggaaataagagagaaaagaagagtaagaagaaatataagagccaccatgccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgctgataataggctggagcctcggtggccatgcttcttgccccttgggcctccccccagcccctcctccccttcctgcacccgtacccccgtggtctttgaataaagtctgagtgggcggc

SEQ ID NO: 9 - DNA, 2800 bp, Chikungunya virus
tcaagcttttggaccctcgtacagaagctaatacgactcactatagggaaataagagagaaaagaagagtaagaagaaatataagagccaccatgagtaccaaggacaacttcaatgtctataaagccacaagaccgtacttagctcactgtcccgactgtggagaagggcactcgtgccatagtcccgtagcattagaacgcatcagaaatgaagcgacagacgggacgctgaaaatccaggtctccttgcaaatcggaataaagacggatgatagccacgattggaccaagctgcgttacatggacaaccacacgccagcggacgcagagagggcggggctatttgtaagaacatcagcaccgtgcacgattactggaacaatgggacacttcatcctgacccgatgtccgaaaggggaaactctgacggtgggattcactgacagtaggaagatcagtcactcatgtacgcacccatttcaccacgaccctcctgtgataggccgggagaaattccattcccgaccgcagcacggtaaagagctgccttgcagcacgtacgtgcagagcaccgccgcaactaccgaggagatagaggtacacatgcccccagacacccctgatcgcacattgatgtcacaacagtccggcaacgtaaagatcacagttaatggccagacggtgcggtacaagtgtaattgcggtggctcaaatgaaggactaataactacagacaaagtgattaataactgcaaagttgatcaatgtcatgccgcggtcaccaatcacaaaaagtggcagtacaactcccctctggtcccgcgtaatgctgaacttggggaccgaaaaggaaaaatccacatcccgtttccgctggcaaatgtaacatgcagggtgcctaaagcaaggaaccccaccgtgacgtacgggaaaaaccaagtcatcatgctactgtatcccgaccacccaacactcctgtcctaccggaacatgggagaagaaccaaactaccaagaagagtgggtgacgcataagaaggaagtcgtgctaaccgtgccgactgaagggctcgaggtcacgtggggtaacaacgagccgtataagtattggccgcagttatctacaaacggtacagcccatggccacccgcatgagataattctgtattattatgagctgtaccctactatgactgtagtagttgtgtcagtggcctcgttcgtactcctgtcgatggtgggtgtggcagtggggatgtgcatgtgtgcacgacgcagatgcatcacaccgtacgaactgacaccaggagctaccgtccctttcctgcttagcctaatatgctgcatcagaacagctaaagcgtacgaacacgtaacagtgatcccgaacacggtgggagtaccgtataagactctagtcaatagaccgggctacagtcccatggtattggagatggaactactgtcagtcactttggagccaacgctatcgcttgattacatcacgtgcgagtacaaaaccgttatcccgtctccgtacgtgaaatgctgcggtacagcagagtgcaaggacaaaaacctacctgactacagctgtaaggtcttcaccggcgtctacccatttatgtggggcggagcctactgcttctgcgacgctgaaaacacgcaattgagcgaagcacacgtggagaagtccgaatcatgcaaaacagaatttgcatcagcatacagggctcataccgcatccgcatcagctaagctccgcgtcctttaccaaggaaataacatcactgtaactgcctatgctaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgcgggtacggtacatgtgccatactctcaggcaccatctggctttaagtattggctaaaagaacgaggggcgtcgctgcagcacacagcaccatttggctgccaaatagcaacaaacccggtaagagcggtgaattgcgccgtagggaacatgcccatctccatcgacataccggatgcggccttcattagggtcgtcgacgcgccctctttaacggacatgtcgtgcgaggtaccagcctgcacccattcctcagatttcgggggcgtcgccattattaaatatgcagccagcaagaaaggcaagtgtgcggtgcattcgatgaccaacgccgtcacaattcgggaagctgagatagaagttgaagggaattctcagctgcaaatctctttctcgacggccttggccagcgccgaattccgcgtacaagtctgttctacacaagtacactgtgtagccgagtgccaccctccgaaggaccacatagtcaattacccggcgtcacataccaccctcggggtccaggacatttccgctacggcgctgtcatgggtgcagaagatcacgggaggcgtgggactggttgtcgctgttgcagcactgattctaatcgtggtgctatgcgtgtcgttcagcaggcactgataataggctggagcctcggtggccatgcttcttgccccttgggcctccccccagcccctcctccccttcctgcacccgtacccccgtggtctttgaataaagtctgagtgggcggc

SEQ ID NO: 10 - DNA, 5389 bp, Chikungunya virus
tcaagcttttggaccctcgtacagaagctaatacgactcactatagggaaataagagagaaaagaagagtaagaagaaatataagagccaccatgagtattaaggaccacttcaatgtctataaagccacaagaccgtacctagctcactgtcccgactgtggagaagggcactcgtgccatagtcccgtagcgctagaacgcatcagaaacgaagcgacagacgggacgttgaaaatccaggtttccttgcaaatcggaataaagacggatgatagccatgattggaccaagctgcgttatatggacaatcacatgccagcagacgcagagcgggccgggctatttgtaagaacgtcagcaccgtgcacgattactggaacaatgggacacttcattctggcccgatgtccgaaaggagaaactctgacggtggggttcactgacggtaggaagatcagtcactcatgtacgcacccatttcaccatgaccctcctgtgataggccgggaaaaattccattcccgaccgcagcacggtagggaactaccttgcagcacgtacgcgcagagcaccgctgcaactgccgaggagatagaggtacacatgcccccagacaccccagatcgcacattaatgtcacaacagtccggcaatgtaaagatcacagtcaatagtcagacggtgcggtacaagtgcaattgtggtgactcaagtgaaggattaaccactacagataaagtgattaataactgcaaggtcgatcaatgccatgccgcggtcaccaatcacaaaaaatggcagtataactcccctctggtcccgcgtaatgctgaattcggggaccggaaaggaaaagttcacattccatttcctctggcaaatgtgacatgcagggtgcctaaagcaagaaaccccaccgtgacgtacggaaaaaaccaagtcatcatgttgctgtatcctgaccacccaacgctcctgtcctacaggaatatgggagaagaaccaaactatcaagaagagtgggtgacgcataagaaggagatcaggttaaccgtgccgactgaggggctcgaggtcacgtggggtaacaatgagccgtacaagtattggccgcagttatccacaaacggtacagcccacggccacccgcatgagataattctgtattattatgagctgtacccaactatgactgcggtagttttgtcagtggcctcgttcatactcctgtcgatggtgggtgtggcagtggggatgtgcatgtgtgcacgacgcagatgcattacaccgtacgaactgacaccaggagctaccgtccctttcctgcttagcctaatatgctgcattagaacagctaaagcgtacgaacacgtaacagtgatcccgaacacggtgggagtaccgtataagactctagtcaacagaccgggctacagccccatggtattggagatggagcttctgtctgtcaccttggaaccaacgctatcgcttgattacatcacgtgcgagtataaaaccgttatcccgtctccgtacgtgaaatgctgcggtacagcagagtgtaaggacaagagcctacctgattacagctgtaaggtcttcaccggcgtctacccattcatgtggggcggcgcctactgcttctgcgacaccgaaaatacgcaattgagcgaagcacatgtggagaagtccgaatcatgcaaaacagaatttgcatcagcatacagggctcataccgcatccgcatcagctaagctccgcgtcctttaccaaggaaataatatcactgtggctgcttatgcaaacggcgaccatgccgtcacagttaaggacgctaaattcatagtggggccaatgtcttcagcctggacacctttcgacaataaaatcgtggtgtacaaaggcgacgtctacaacatggactacccgcccttcggcgcaggaagaccaggacaatttggcgacatccaaagtcgcacgcctgagagcgaagacgtctatgctaatacacaactggtactgcagagaccgtccgcgggtacggtgcacgtgccgtactctcaggcaccatctggcttcaagtattggctaaaagaacgaggggcgtcgctgcagcacacagcaccatttggctgtcaaatagcaacaaacccggtaagagcgatgaactgcgccgtagggaacatgcctatctccatcgacataccggacgcggcctttaccagggtcgtcgacgcgccatctttaacggacatgtcgtgtgaggtatcagcctgcacccattcctcagactttgggggcgtagccatcattaaatatgcagccagtaagaaaggcaagtgtgcagtgcactcgatgactaacgccgtcactattcgggaagctgaaatagaagtagaagggaactctcagttgcaaatctctttttcgacggccctagccagcgccgaatttcgcgtacaagtctgttctacacaagtacactgtgcagccgagtgccatccaccgaaagaccatatagtcaattacccggcgtcacacaccaccctcggggtccaagacatttccgctacggcgatgtcatgggtgcagaagatcacgggaggtgtgggactggttgtcgctgttgcagcactgatcctaatcgtggtgctatgcgtgtcgtttagcaggcacatgagtattaaggaccacttcaatgtctataaagccacaagaccgtacctagctcactgtcccgactgtggagaagggcactcgtgccatagtcccgtagcgctagaacgcatcagaaacgaagcgacagacgggacgttgaaaatccaggtttccttgcaaatcggaataaagacggatgatagccatgattggaccaagctgcgttatatggacaatcacatgccagcagacgcagagcgggccgggctatttgtaagaacgtcagcaccgtgcacgattactggaacaatgggacacttcattctggcccgatgtccgaaaggagaaactctgacggtggggttcactgacggtaggaagatcagtcactcatgtacgcacccatttcaccatgaccctcctgtgataggccgggaaaaattccattcccgaccgcagcacggtagggaactaccttgcagcacgtacgcgcagagcaccgctgcaactgccgaggagatagaggtacacatgcccccagacaccccagatcgcacattaatgtcacaacagtccggcaatgtaaagatcacagtcaatagtcagacggtgcggtacaagtgcaattgtggtgactcaagtgaaggattaaccactacagataaagtgattaataactgcaaggtcgatcaatgccatgccgcggtcaccaatcacaaaaaatggcagtataactcccctctggtcccgcgtaatgctgaattcggggaccggaaaggaaaagttcacattccatttcctctggcaaatgtgacatgcagggtgcctaaagcaagaaaccccaccgtgacgtacggaaaaaaccaagtcatcatgttgctgtatcctgaccacccaacgctcctgtcctacaggaatatgggagaagaaccaaactatcaagaagagtgggtgacgcataagaaggagatcaggttaaccgtgccgactgaggggctcgaggtcacgtggggtaacaatgagccgtacaagtattggccgcagttatccacaaacggtacagcccacggccacccgcatgagataattctgtattattatgagctgtacccaactatgactgcggtagttttgtcagtggcctcgttcatactcctgtcgatggtgggtgtggcagtggggatgtgcatgtgtgcacgacgcagatgcattacaccgtacgaactgacaccaggagctaccgtccctttcctgcttagcctaatatgctgcattagaacagctaaagcgtacgaacacgtaacagtgatcccgaacacggtgggagtaccgtataagactctagtcaacagaccgggctacagccccatggtattggagatggagcttctgtctgtcaccttggaaccaacgctatcgcttgattacatcacgtgcgagtataaaaccgttatcccgtctccgtacgtgaaatgctgcggtacagcagagtgtaaggacaagagcctacctgattacagctgtaaggtcttcaccggcgtctacccattcatgtggggcggcgcctactgcttctgcgacaccgaaaatacgcaattgagcgaagcacatgtggagaagtccgaatcatgcaaaacagaatttgcatcagcatacagggctcataccgcatccgcatcagctaagctccgcgtcctttaccaaggaaataatatcactgtggctgcttatgcaaacggcgaccatgccgtcacagttaaggacgctaaattcatagtggggccaatgtcttcagcctggacacctttcgacaataaaatcgtggtgtacaaaggcgacgtctacaacatggactacccgcccttcggcgcaggaagaccaggacaatttggcgacatccaaagtcgcacgcctgagagcgaagacgtctatgctaatacacaactggtactgcagagaccgtccgcgggtacggtgcacgtgccgtactctcaggcaccatctggcttcaagtattggctaaaagaacgaggggcgtcgctgcagcacacagcaccatttggctgtcaaatagcaacaaacccggtaagagcgatgaactgcgccgtagggaacatgcctatctccatcgacataccggacgcggcctttaccagggtcgtcgacgcgccatctttaacggacatgtcgtgtgaggtatcagcctgcacccattcctcagactttgggggcgtagccatcattaaatatgcagccagtaagaaaggcaagtgtgcagtgcactcgatgactaacgccgtcactattcgggaagctgaaatagaagtagaagggaactctcagttgcaaatctctttttcgacggccctagccagcgccgaatttcgcgtacaagtctgttctacacaagtacactgtgcagccgagtgccatccaccgaaagaccatatagtcaattacccggcgtcacacaccaccctcggggtccaagacatttccgctacggcgatgtcatgggtgcagaagatcacgggaggtgtgggactggttgtcgctgttgcagcactgatcctaatcgtggtgctatgcgtgtcgtttagcaggcactgataataggctggagcctcggtggccatgcttcttgccccttgggcctccccccagcccctcctccccttcctgcacccgtacccccgtggtctttgaataaagtctgagtgggcggc

SEQ ID NO: 11 - DNA, 2902 bp, Chikungunya virus
tcaagcttttggaccctcgtacagaagctaatacgactcactatagggaaataagagagaaaagaagagtaagaagaaatataagagccaccatgccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaatgataataggctggagcctcggtggccatgcttcttgccccttgggcctccccccagcccctcctccccttcctgcacccgtacccccgtggtctttgaataaagtctgagtgggcggc

SEQ ID NO: 12 - DNA, 3979 bp, Artificial Sequence
  Synthetic Polynucleotide
tcaagcttttggaccctcgtacagaagctaatacgactcactatagggaaataagagagaaaagaagagtaagaagaaatataagagccaccatggagtttatccctacgcagacgttctataatcggaggtaccagcccaggccttgggccccccgccctacaatccaagtgataagaccacgtcccaggccgcagagacaagccggccaattggcgcaactcatcagcgcagttaacaagttgaccatgcgagcggttcctcagcagaagccgaggcggaaccggaagaataagaaacaacgccaaaagaaacaggcgccgcagaacgaccctaaacagaagaaacaacctccccagaaaaagccagctcagaagaagaagaagcctggacgccgtgaaagaatgtgcatgaaaatcgaaaatgattgcatctttgaggtgaagcacgagggcaaagtgatggggtacgcatgcctggtgggcgataaggtcatgaagccagcacatgtgaaggggacaatcgataatgctgatctggccaagctagcttttaaacgtagctccaaatacgatcttgagtgtgcccagatacctgtgcacatgaaatctgatgcaagcaagttcacacacgagaagcctgagggctattataactggcatcatggtgcggttcagtactccggcggccgatttaccattcctacaggggcaggaaagccgggcgattcggggagacccattttcgacaacaaaggccgcgtggtagctatcgtgctcggtggggctaatgagggtgcacgtactgcacttagcgtggttacctggaataaggacattgtcacaaagattacaccggagggagcagaggaatggagcctggcactgcccgttctgtgcctgctggccaacaccactttcccatgtagtcaacccccttgcactccctgctgctatgagaaagagcctgagagcacgttacgtatgctggaagataatgtcatgaggcccgggtactatcaactgctcaaggctagtctgacatgctcgccccacaggcagcgcaggtccacgaaagataacttcaacgtttacaaggctactaggccttatttggcccactgtcccgattgcggagagggacattcttgtcatagtcctattgccttggagcgaatccgcaacgaggccactgatggaacccttaagattcaagtatctttgcagattggcattaagacagatgattcccatgactggacaaagcttcggtacatggactcacacacgcctgcagatgctgaaagggcagggctcttggtcaggacctcggccccttgtacaattaccgggaccatgggccacttcatccttgcacgctgccctaagggggagacgctgacggtgggctttactgactcgcgtaagatctcacacacatgtacacaccctttccaccacgaacctccagtcatagggagagagagatttcactctcgcccacagcatggcaaagagctgccatgctccacatatgtccagagcactgctgctaccgctgaagaaattgaggttcacatgccacccgatacaccagaccgtactctgatgacccaacagagcggcaacgtgaagattaccgtaaatggacagaccgtgagatataagtgcaactgtggtggctccaatgagggcttaacaacaacggataaggtgattaacaattgcaaaatagatcagtgccatgccgcagtgaccaatcacaagaattggcaatacaactcacccctagtgccgaggaacgcagaactaggcgacaggaaagggaaaatccatatacccttccccctagcaaatgtgacctgccgagtgcccaaggccagaaaccccacggttacttacggcaagaaccaggtgacgatgcttttgtacccagaccatcccaccttgctctcttatagaaacatgggacaggagcctaactatcatgaggagtgggtgacacacaagaaagaagtcacccttaccgtgcctaccgaagggcttgaagtcacctggggcaacaacgagccttacaagtattggccacagatgtccacaaacggaacagcccacggccacccgcacgagatcatactgtattactatgagctttatcccacaatgactgtcgtaattgtgagcgttgccagcttcgtgttgctttcaatggttggcactgccgtggggatgtgcgtgtgtgctaggcgccgctgtataactccttatgaactaactccaggcgccaccgttcctttcctgctctcactactgtgttgtgtgcgcacaacaaaggctgccacctactacgaagccgccgcctacttatggaatgaacagcagcctctcttttggttacaggcgctgattcctcttgctgccctgatcgtgctatgcaactgcctcaagctgctgccctgttgttgcaagaccctagcttttctcgccgtgatgagcatcggggcacatacagtgtccgcctatgagcacgtcaccgttatcccgaacaccgtcggtgtgccatataagacgttagtcaatcgacccggctactctccaatggtgctggaaatggaactccagagtgtgacactggagccaaccttatccctcgattatattacctgcgaatacaagaccgtcatcccttcaccctatgtcaagtgctgtgggaccgctgaatgcaaagacaagagcttgcctgattacagttgcaaggtcttcacaggtgtgtaccccttcatgtgggggggagcttattgcttttgtgatgctgagaacacccaactgagcgaggctcacgtcgagaaatctgagtcttgcaagaccgagtttgcctcagcttacagggcccacacggccagcgcatccgccaaattgagggtactctaccagggtaataatatcaccgttgccgcatatgcaaacggcgatcacgccgtgactgtcaaggatgccaagttcgttgtgggccccatgtctagcgcttggacaccgttcgataataagatcgtcgtgtacaaaggggacgtgtataatatggactacccacctttcggggccggccgaccgggacagttcggggatattcagagccgcacacccgaatctaaagatgtttacgccaatactcagctcgtcctgcagaggcccgccgctggtacagttcacgttccttactcacaggcaccctctgggtttaagtattggctgaaagaacgaggtgccagcttgcagcatacagcgcctttcggatgccagattgccactaaccccgtacgggctgtcaactgcgcggtcggcaatattcccattagcattgatatcccggacgcagctttcaccagggttgtggacgccccgagcgtcaccgacatgagttgtgaggtgccagcctgcacgcatagcagtgatttcggcggcgtcgccatcattaaatataccgcaagcaagaaaggcaagtgcgccgtccactcgatgactaacgccgtcacaattcgggaagccgatgttgaggtcgaaggcaactcccagctgcagatcagcttctctactgctcttgcaagcgccgagtttcgagtccaggtctgcagtacgcaggtgcattgtgcagctgcctgccatccacccaaagatcatattgtgaattatccggcgtcacataccacactgggggtccaggatattagtacaacggcgatgtcctgggtgcagaaaattacgggaggagtgggcttaattgttgccgtggcggccctgatcctgatcgttgtgctgtgtgttagcttctctaggcatgactataaagatgacgatgacaaatgataataggctggagcctcggtggccatgcttcttgccccttgggcctccccccagcccctcctccccttcctgcacccgtacccccgtggtctttgaataaagtctgagtgggcggc

SEQ ID NO: 13 - DNA, 3955 bp, Artificial Sequence
  Synthetic Polynucleotide
tcaagcttttggaccctcgtacagaagctaatacgactcactatagggaaataagagagaaaagaagagtaagaagaaatataagagccaccatggagtttatccctacgcagacgttctataatcggaggtaccagcccaggccttgggccccccgccctacaatccaagtgataagaccacgtcccaggccgcagagacaagccggccaattggcgcaactcatcagcgcagttaacaagttgaccatgcgagcggttcctcagcagaagccgaggcggaaccggaagaataagaaacaacgccaaaagaaacaggcgccgcagaacgaccctaaacagaagaaacaacctccccagaaaaagccagctcagaagaagaagaagcctggacgccgtgaaagaatgtgcatgaaaatcgaaaatgattgcatctttgaggtgaagcacgagggcaaagtgatggggtacgcatgcctggtgggcgataaggtcatgaagccagcacatgtgaaggggacaatcgataatgctgatctggccaagctagcttttaaacgtagctccaaatacgatcttgagtgtgcccagatacctgtgcacatgaaatctgatgcaagcaagttcacacacgagaagcctgagggctattataactggcatcatggtgcggttcagtactccggcggccgatttaccattcctacaggggcaggaaagccgggcgattcggggagacccattttcgacaacaaaggccgcgtggtagctatcgtgctcggtggggctaatgagggtgcacgtactgcacttagcgtggttacctggaataaggacattgtcacaaagattacaccggagggagcagaggaatggagcctggcactgcccgttctgtgcctgctggccaacaccactttcccatgtagtcaacccccttgcactccctgctgctatgagaaagagcctgagagcacgttacgtatgctggaagataatgtcatgaggcccgggtactatcaactgctcaaggctagtctgacatgctcgccccacaggcagcgcaggtccacgaaagataacttcaacgtttacaaggctactaggccttatttggcccactgtcccgattgcggagagggacattcttgtcatagtcctattgccttggagcgaatccgcaacgaggccactgatggaacccttaagattcaagtatctttgcagattggcattaagacagatgattcccatgactggacaaagcttcggtacatggactcacacacgcctgcagatgctgaaagggcagggctcttggtcaggacctcggccccttgtacaattaccgggaccatgggccacttcatccttgcacgctgccctaagggggagacgctgacggtgggctttactgactcgcgtaagatctcacacacatgtacacaccctttccaccacgaacctccagtcatagggagagagagatttcactctcgcccacagcatggcaaagagctgccatgctccacatatgtccagagcactgctgctaccgctgaagaaattgaggttcacatgccacccgatacaccagaccgtactctgatgacccaacagagcggcaacgtgaagattaccgtaaatggacagaccgtgagatataagtgcaactgtggtggctccaatgagggcttaacaacaacggataaggtgattaacaattgcaaaatagatcagtgccatgccgcagtgaccaatcacaagaattggcaatacaactcacccctagtgccgaggaacgcagaactaggcgacaggaaagggaaaatccatatacccttccccctagcaaatgtgacctgccgagtgcccaaggccagaaaccccacggttacttacggcaagaaccaggtgacgatgcttttgtacccagaccatcccaccttgctctcttatagaaacatgggacaggagcctaactatcatgaggagtgggtgacacacaagaaagaagtcacccttaccgtgcctaccgaagggcttgaagtcacctggggcaacaacgagccttacaagtattggccacagatgtccacaaacggaacagcccacggccacccgcacgagatcatactgtattactatgagctttatcccacaatgactgtcgtaattgtgagcgttgccagcttcgtgttgctttcaatggttggcactgccgtggggatgtgcgtgtgtgctaggcgccgctgtataactccttatgaactaactccaggcgccaccgttcctttcctgctctcactactgtgttgtgtgcgcacaacaaaggctgccacctactacgaagccgccgcctacttatggaatgaacagcagcctctcttttggttacaggcgctgattcctcttgctgccctgatcgtgctatgcaactgcctcaagctgctgccctgttgttgcaagaccctagcttttctcgccgtgatgagcatcggggcacatacagtgtccgcctatgagcacgtcaccgttatcccgaacaccgtcggtgtgccatataagacgttagtcaatcgacccggctactctccaatggtgctggaaatggaactccagagtgtgacactggagccaaccttatccctcgattatattacctgcgaatacaagaccgtcatcccttcaccctatgtcaagtgctgtgggaccgctgaatgcaaagacaagagcttgcctgattacagttgcaaggtcttcacaggtgtgtaccccttcatgtgggggggagcttattgcttttgtgatgctgagaacacccaactgagcgaggctcacgtcgagaaatctgagtcttgcaagaccgagtttgcctcagcttacagggcccacacggccagcgcatccgccaaattgagggtactctaccagggtaataatatcaccgttgccgcatatgcaaacggcgatcacgccgtgactgtcaaggatgccaagttcgttgtgggccccatgtctagcgcttggacaccgttcgataataagatcgtcgtgtacaaaggggacgtgtataatatggactacccacctttcggggccggccgaccgggacagttcggggatattcagagccgcacacccgaatctaaagatgtttacgccaatactcagctcgtcctgcagaggcccgccgctggtacagttcacgttccttactcacaggcaccctctgggtttaagtattggctgaaagaacgaggtgccagcttgcagcatacagcgcctttcggatgccagattgccactaaccccgtacgggctgtcaactgcgcggtcggcaatattcccattagcattgatatcccggacgcagctttcaccagggttgtggacgccccgagcgtcaccgacatgagttgtgaggtgccagcctgcacgcatagcagtgatttcggcggcgtcgccatcattaaatataccgcaagcaagaaaggcaagtgcgccgtccactcgatgactaacgccgtcacaattcgggaagccgatgttgaggtcgaaggcaactcccagctgcagatcagcttctctactgctcttgcaagcgccgagtttcgagtccaggtctgcagtacgcaggtgcattgtgcagctgcctgccatccacccaaagatcatattgtgaattatccggcgtcacataccacactgggggtccaggatattagtacaacggcgatgtcctgggtgcagaaaattacgggaggagtgggcttaattgttgccgtggcggccctgatcctgatcgttgtgctgtgtgttagcttctctaggcattgataataggctggagcctcggtggccatgcttcttgccccttgggcctccccccagcccctcctccccttcctgcacccgtacccccgtggtctttgaataaagtctgagtgggcggc

SEQ ID NO: 14 - protein, 1262 aa, Artificial Sequence
  Synthetic Polypeptide
SSFWTLVQKLIRLTIGKERKEEEEIEPPWSLSLRRRSIIGGTSPGLGPPALQSKDHVPGRRDKPANWRNSSAQLTSPCERFLSRSRGGTGRIRNNAKRNRRRRTTLNRRNNLPRKSQLRRRRSLDAVKECAKSKMIASLRSTRAKWGTHAWWAIRSSQHMRGQSIMLIWPSLLNVAPNTILSVPRYLCTNLMQASSHTRSLRAIITGIMVRFSTPAADLPFLQGQESRAIRGDPFSTTKAAWLSCSVGLMRVHVLHLAWLPGIRTLSQRLHRREQRNGAWHCPFCACWPTPLSHVVNPLALPAAMRKSLRARYVCWKIMSGPGTINCSRLVHARPTGSAGPRKITSTFTRLLGLIWPTVPIAERDILVIVLLPWSESATRPLMEPLRFKYLCRLALRQMIPMTGQSFGTWTHTRLQMLKGQGSWSGPRPLVQLPGPWATSSLHAALRGRRRWALLTRVRSHTHVHTLSTTNLQSGERDFTLAHSMAKSCHAPHMSRALLLPLKKLRFTCHPIHQTVLPNRAATRLPMDRPDISATVVAPMRAQQRIRLTIAKISAMPQPITRIGNTTHPCRGTQNATGKGKSIYPSPQMPAECPRPETPRLLTARTRRCFCTQTIPPCSLIETWDRSLTIMRSGHTRKKSPLPCLPKGLKSPGATTSLTSIGHRCPQTEQPTATRTRSYCITMSFIPQLSLALPASCCFQWLALPWGCACVLGAAVLLMNLQAPPFLSCSHYCVVCAQQRLPPTTKPPPTYGMNSSLSFGYRRFLLLPSCYATASSCCPVVARPLFSPASGHIQCPPMSTSPLSRTPSVCHIRRSIDPATLQWCWKWNSRVHWSQPYPSIILPANTRPSSLHPMSSAVGPLNAKTRACLITVARSSQVCTPSCGGELIAFVMLRTPNARLTSRNLSLARPSLPQLTGPTRPAHPPNGYSTRVIISPLPHMQTAITPLSRMPSSLWAPCLALGHRSIIRSSCTKGTCIIWTTHLSGPADRDSSGIFRAAHPNLKMFTPILSSSCRGPPLVQFTFLTHRHPLGLSIGKNEVPACSIQRLSDARLPLTPYGLSTARSAIFPLALISRTQLSPGLWTPRASPTVVRCQPARIAVISAASPSLNIPQARKASAPSTRLTPSQFGKPMLRSKATPSCRSASLLLLQAPSFESRSAVRRCIVQLPAIHPKIILIIRRHIPHWGSRILVQRRCPGCRKLREEWALLPWRPSSLCCVLASLGIDNRLEPRWPCFLPLGPPPSPSSPSCTRTPVVFESLSGR

SEQ ID NO: 15 - protein, 3389 aa, Dengue virus
MNNQRKKTGRPSFNMLKRARNRVSTVSQLAKRFSKGLLSGQGPMKLVMAFIAFLRFLAIPPTAGILARWGSFKKNGAIKVLRGFKKEISNMLNIMNRRKRSVTMLLMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKKKSWLVHKQWFLDLPLPWTSGASTSQETWNRQDLLVTFKTAHAKKQEVVVLGSQEGAMHTALTGATEIQTSGTTTIFAGHLKCRLKMDKLILKGMSYVMCTGSFKLEKEVAETQHGTVLVQVKYEGTDAPCKIPFSSQDEKGVTQNGRLITANPIVTDKEKPVNIEAEPPFGESYIVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKTIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDKMGMGTTYLALMATFRMRPMFAVGLLFRRLTSREVLLLTVGLSLVASVELPNSLEELGDGLAMGIMMLKLLTDFQSHQLWATLLSLTFVKTTFSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNAGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVIASSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLKKHGTERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDFMTSMKRFKNESDPEGALW

SEQ ID NO: 16 - DNA, 10735 bp, Dengue virus
agttgttagtctacgtggaccgacaagaacagtttcgaatcggaagcttgcttaacgtagttctaacagttttttattagagagcagatctctgatgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggcttttatagcattcctaagatttctagccatacctccaacagcaggaattttggctagatggggctcattcaagaagaatggagcgatcaaagtgttacggggtttcaagaaagaaatctcaaacatgttgaacataatgaacaggaggaaaagatctgtgaccatgctcctcatgctgctgcccacagccctggcgttccatctgaccacccgagggggagagccgcacatgatagttagcaagcaggaaagaggaaaatcacttttgtttaagacctctgcaggtgtcaacatgtgcacccttattgcaatggatttgggagagttatgtgaggacacaatgacctacaaatgcccccggatcactgagacggaaccagatgacgttgactgttggtgcaatgccacggagacatgggtgacctatggaacatgttctcaaactggtgaacaccgacgagacaaacgttccgtcgcactggcaccacacgtagggcttggtctagaaacaagaaccgaaacgtggatgtcctctgaaggcgcttggaaacaaatacaaaaagtggagacctgggctctgagacacccaggattcacggtgatagccctttttctagcacatgccataggaacatccatcacccagaaagggatcatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacaaaccaacactggacattgaactcttgaagacggaggtcacaaaccctgccgtcctgcgcaaactgtgcattgaagctaaaatatcaaacaccaccaccgattcgagatgtccaacacaaggagaagccacgctggtggaagaacaggacacgaactttgtgtgtcgacgaacgttcgtggacagaggctggggcaatggttgtgggctattcggaaaaggtagcttaataacgtgtgctaagtttaagtgtgtgacaaaactggaaggaaagatagtccaatatgaaaacttaaaatattcagtgatagtcaccgtacacactggagaccagcaccaagttggaaatgagaccacagaacatggaacaactgcaaccataacacctcaagctcccacgtcggaaatacagctgacagactacggagctctaacattggattgttcacctagaacagggctagactttaatgagatggtgttgttgacaatgaaaaaaaaatcatggctcgtccacaaacaatggtttctagacttaccactgccttggacctcgggggcttcaacatcccaagagacttggaatagacaagacttgctggtcacatttaagacagctcatgcaaaaaagcaggaagtagtcgtactaggatcacaagaaggagcaatgcacactgcgttgactggagcgacagaaatccaaacgtctggaacgacaacaatttttgcaggacacctgaaatgcagattaaaaatggataaactgattttaaaagggatgtcatatgtaatgtgcacagggtcattcaagttagagaaggaagtggctgagacccagcatggaactgttctagtgcaggttaaatacgaaggaacagatgcaccatgcaagatccccttctcgtcccaagatgagaagggagtaacccagaatgggagattgataacagccaaccccatagtcactgacaaagaaaaaccagtcaacattgaagcggagccaccttttggtgagagctacattgtggtaggagcaggtgaaaaagctttgaaactaagctggttcaagaagggaagcagtatagggaaaatgtttgaagcaactgcccgtggagcacgaaggatggccatcctgggagacactgcatgggacttcggttctataggaggggtgttcacgtctgtgggaaaactgatacaccagatttttgggactgcgtatggagttttgttcagcggtgtttcttggaccatgaagataggaatagggattctgctgacatggctaggattaaactcaaggagcacgtccctttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatataaattccaggccgactcccctaagagactatcagcggccattgggaaggcatgggaggagggtgtgtgtggaattcgatcagccactcgtctcgagaacatcatgtggaagcaaatatcaaatgaattaaaccacatcttacttgaaaatgacatgaaatttacagtggtcgtaggagacgttagtggaatcttggcccaaggaaagaaaatgattaggccacaacccatggaacacaaatactcgtggaaaagctggggaaaagccaaaatcataggagcagatgtacagaataccaccttcatcatcgacggcccaaacaccccagaatgccctgataaccaaagagcatggaacatttgggaagttgaagactatggatttggaattttcacgacaaacatatggttgaaattgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaactacagaccaggatatttcacacaaacagcagggccgtggcacttgggcaagttagaactagattttgatttatgtgaaggtaccactgttgttgtggatgaacattgtggaaatcgaggaccatctcttagaaccacaacagtcacaggaaagacaatccatgaatggtgctgtagatcttgcacgttaccccccctacgtttcaaaggagaagacgggtgctggtacggcatggaaatcagaccagtcaaggagaaggaagagaacctagttaagtcaatggtctctgcagggtcaggagaagtggacagtttttcactaggactgctatgcatatcaataatgatcgaagaggtaatgagatccagatggagcagaaaaatgctgatgactggaacattggctgtgttcctccttctcacaatgggacaattgacatggaatgatctgatcaggctatgtatcatggttggagccaacgcttcagacaagatggggatgggaacaacgtacctagctttgatggccactttcagaatgagaccaatgttcgcagtcgggctactgtttcgcagattaacatctagagaagttcttcttcttacagttggattgagtctggtggcatctgtagaactaccaaattccttagaggagctaggggatggacttgcaatgggcatcatgatgttgaaattactgactgattttcagtcacatcagctatgggctaccttgctgtctttaacatttgtcaaaacaactttttcattgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttataacagaaaacaaaatctggggaaggaaaagctggcctctcaatgaaggaattatggctgttggaatagttagcattcttctaagttcacttctcaagaatgatgtgccactagctggcccactaatagctggaggcatgctaatagcatgttatgtcatatctggaagctcggccgatttatcactggagaaagcggctgaggtctcctgggaagaagaagcagaacactctggtgcctcacacaacatactagtggaggtccaagatgatggaaccatgaagataaaggatgaagagagagatgacacactcaccattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggcatttatagaattctccaaagaggattgttgggcaggtctcaagtaggagtaggagtttttcaagaaggcgtgttccacacaatgtggcacgtcaccaggggagctgtcctcatgtaccaagggaagagactggaaccaagttgggccagtgtcaaaaaagacttgatctcatatggaggaggttggaggtttcaaggatcctggaacgcgggagaagaagtgcaggtgattgctgttgaaccggggaagaaccccaaaaatgtacagacagcgccgggtaccttcaagacccctgaaggcgaagttggagccatagctctagactttaaacccggcacatctggatctcctatcgtgaacagagagggaaaaatagtaggtctttatggaaatggagtggtgacaacaagtggtacctacgtcagtgccatagctcaagctaaagcatcacaagaagggcctctaccagagattgaggacgaggtgtttaggaaaagaaacttaacaataatggacctacatccaggatcgggaaaaacaagaagataccttccagccatagtccgtgaggccataaaaagaaagctgcgcacgctagtcttagctcccacaagagttgtcgcttctgaaatggcagaggcgctcaagggaatgccaataaggtatcagacaacagcagtgaagagtgaacacacgggaaaggagatagttgaccttatgtgtcacgccactttcactatgcgtctcctgtctcctgtgagagttcccaattataatatgattatcatggatgaagcacattttaccgatccagccagcatagcagccagagggtatatctcaacccgagtgggtatgggtgaagcagctgcgattttcatgacagccactccccccggatcggtggaggcctttccacagagcaatgcagttatccaagatgaggaaagagacattcctgaaagatcatggaactcaggctatgactggatcactgatttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaataacgactgggactatgttgtcacaacagacatatccgaaatgggagcaaacttccgagccgacagggtaatagacccgaggcggtgcctgaaaccggtaatactaaaagatggcccagagcgtgtcattctagccggaccgatgccagtgactgtggctagcgccgcccagaggagaggaagaattggaaggaaccaaaataaggaaggcgatcagtatatttacatgggacagcctctaaacaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaacgttcgtggagctcatgagaagaggagatctacctgtctggctatcctacaaagttgcctcagaaggcttccagtactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaacgccttggacaatctggttatgttgcacaactctgaacaaggaggaaaagcctatagacacgccatggaagaactaccagacaccatagaaacgttaatgctcctagctttgatagctgtgctgactggtggagtgacgttgttcttcctatcaggaaggggtctaggaaaaacatccattggcctactctgcgtgattgcctcaagtgcactgttatggatggccagtgtggaaccccattggatagcggcctctatcatactggagttctttctgatggtgttgcttattccagagccggacagacagcgcactccacaagacaaccagctagcatacgtggtgataggtctgttattcatgatattgacagtggcagccaatgagatgggattactggaaaccacaaagaaggacctggggattggtcatgcagctgctgaaaaccaccatcatgctgcaatgctggacgtagacctacatccagcttcagcctggactctctatgcagtggccacaacaattatcactcccatgatgagacacacaattgaaaacacaacggcaaatatttccctgacagctattgcaaaccaggcagctatattgatgggacttgacaagggatggccaatatcaaagatggacataggagttccacttctcgccttggggtgctattctcaggtgaacccgctgacgctgacagcggcggtattgatgctagtggctcattatgccataattggacccggactgcaagcaaaagctactagagaagctcaaaaaaggacagcagccggaataatgaaaaacccaactgtcgacgggatcgttgcaatagatttggaccctgtggtttacgatgcaaaatttgaaaaacagctaggccaaataatgttgttgatactttgcacatcacagatcctcctgatgcggaccacatgggccttgtgtgaatccatcacactagccactggacctctgactacgctttgggagggatctccaggaaaattctggaacaccacgatagcggtgtccatggcaaacatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggattatagaggtggatagatctgaagccaaagaggggttaaaaagaggagaaacgactaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacgaaaggaggacctggacatgaggaaccaatcccaatggcaacctatggatggaacctagtaaagctatactccgggaaagatgtattctttacaccacctgagaaatgtgacaccctcttgtgtgatattggtgagtcctctccgaacccaactatagaagaaggaagaacgttacgtgttctaaagatggtggaaccatggctcagaggaaaccaattttgcataaaaattctaaatccctatatgccgagtgtggtagaaactttggagcaaatgcaaagaaaacatggaggaatgctagtgcgaaatccactctcaagaaactccactcatgaaatgtactgggtttcatgtggaacaggaaacattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagatatcattggccagaggatagagaatataaaaaatgaacacaaatcaacatggcattatgatgaggacaatccatacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgacagccaggtggttatggggttttctctctagaaacaaaaaacccagaatctgcacaagagaggagttcacaagaaaagtcaggtcaaacgcagctattggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctattggccacgtcaatctttaagctaacctaccaaaacaaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatcttttcacccagcgaattggaaaccccaaatctagccgaaagagtcctcgactggttgaaaaaacatggcaccgagaggctgaaaagaatggcaatcagtggagatgactgtgtggtgaaaccaatcgatgacagatttgcaacagccttaacagctttgaatgacatgggaaaggtaagaaaagacataccgcaatgggaaccttcaaaaggatggaatgattggcaacaagtgcctttctgttcacaccatttccaccagctgattatgaaggatgggagggagatagtggtgccatgccgcaaccaagatgaacttgtaggtagggccagagtatcacaaggcgccggatggagcttgagagaaactgcatgcctaggcaagtcatatgcacaaatgtggcagctgatgtacttccacaggagagacttgagattagcggctaatgctatctgttcagccgttccagttgattgggtcccaaccagccgcaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaaaagggaagatcaatggtgtggttccctaataggcttaacagcacgagccacctgggccaccaacatacaagtggccataaaccaagtgagaaggctcattgggaatgagaattatctagacttcatgacatcaatgaagagattcaaaaacgagagtgatcccgaaggggcactctggtaagccaactcattcacaaaataaaggaaaataaaaaatcaaacaaggcaagaagtcaggccggattaagccatagcacggtaagagctatgctgcctgtgagccccgtccaaggacgtaaaatgaagtcaggccgaaagccacggttcgagcaagccgtgctgcctgtagctccatcgtggggatgtaaaaacccgggaggctgcaaaccatggaagctgtacgcatggggtagcagactagtggttagaggagacccctcccaagacacaacgcagcagcggggcccaacaccaggggaagctgtaccctggtggtaaggactagaggttagaggagaccccccgcacaacaacaaacagcatattgacgctgggagagaccagagatcctgctgtctctacagcatcattccaggcacagaacgccaaaaaatggaatggtgctgttgaatcaacaggttct

SEQ ID NO: 17 - protein, 3388 aa, Dengue virus
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPILQNAWKVSCTILAVVSVSPLLLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 18 - DNA, 10723 bp, Dengue virus
agttgttagtctacgtggaccgacaaagacagattctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagagggcatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgctcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgttcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcggaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 19 - protein, 3390 aa, Dengue virus
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINQRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWASGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATERGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTLGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWTNGVLESDMIIPKSLAGPISQHNYRPGYHTQTAGPWHLGKLELDFNYCEGTTVVITESCGTRGPSLRTTTVSGKLIHEWCCRSCTLPPLRYMGEDGCWYGMEIRPISEKEENMVKSLVSAGSGKVDNFTMGVLCLAILFEEVLRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGVALGLMALKLITQFETYQLWTALVSLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAPDVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTTPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEDGGRAYRHAVEELPETMETLLLLGLMILLTGGAMLFLISGKGIGKTSIGLICVIASSGMLWMAEVPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDSVIFDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVVPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKAMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKIIQQMDPEHRQLANAIFKLTYQNKVVKVQRPTPTGTVMDIISRKDQRGSGQLGTYGLNTFTNMEAQLVRQMEGEGVLTKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEENPWMEDKTPVTTWENVPYLGKREDQWCGSLIGLTSRATWAQNIPTAIQQVRSLIGNEEFLDYMPSMKRFRKEEESEGAIW

SEQ ID NO: 20 - DNA, 10707 bp, Dengue virus
agttgttagtctacgtggaccgacaagaacagtttcgactcggaagcttgcttaacgtagtgctgacagttttttattagagagcagatctctgatgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaaccaacggaaaaagacatcgctctgtctcatgatgatattgccagcagcacttgctttccacttgacttcacgagatggagagccgcgcatgattgtggggaagaatgaaagaggtaaatccctactttttaagacagcctctggaatcaacatgtgcacactcatagccatggatttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatattattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggatttcaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcataatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgttcgaggccactgaaaggggtgcaaggcgcatggccatcttgggagacacagcttgggactttggatcagtgggtggtgttctgaactcattaggcaaaatggtgcaccaaatatttggaagtgcttatacagccctgttcagtggagtctcttgggtgatgaaaattggaataggtgtcctcttgacttggatagggttgaattcaaaaaacacatccatgtcattttcatgcattgcgataggaatcattacactctatctgggagctgtggtacaagctgacatggggtgtgtcataaactggaagggcaaagaactcaaatgtggaagcggaattttcgtcaccaatgaggtccatacctggacagagcaatacaaattccaagcagactccccaaaaagattggcaacagccattgcaggcgcctgggagaatggagtgtgtggaattaggtcaacaaccagaatggagaatctcttgtggaagcaaatagccaatgaactgaactacatattatgggaaaacaatatcaaattaacggtagttgtgggcgatacacttggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtctacacccaactatgtgaccataggctaatgtcggcagctgtcaaggatgagagggccgtgcatgccgacatgggctactggatagaaagccaaaagaatggaagttggaagctagaaaaagcatccctcatagaggtaaaaacctgcacatggccaaaatcacacactctctggactaatggtgtgctagagagtgacatgatcatcccaaagagtctagctggtcctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgttgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacatttaaaatccagccattcttggctttgggatttttcctaagaaagctgacatctagagaaaatttattgttaggagttgggttggccatggcaacaacgttacaactgccagaggacattgaacaaatggcaaatggagtcgctctggggctcatggctcttaaactgataacacaatttgaaacataccaattgtggacggcattagtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcggacctcactgtagaaaaagccccagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggacgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcaaaagggggaggaggtgcaggttattgccgtagagccagggaagaacccaaagaactttcaaaccacgccaggcactttccagactactacaggggaaataggagcaattgcactggatttcaagcctggaacttcaggatctcctatcataaatagagagggaaaggtagtgggactgtatggcaatggagtggttacaaagaatggtggctatgtcagcggaatagcgcaaacaaatgcagaaccagatggaccgacaccagagttggaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggttccaaattacaacttgataataatggatgaggcccatttcacagacccagccagtatagcggctagagggtacatatcaactcgtgttggaatgggagaggcagccgcaatcttcatgacagcaacaccccctggaacagctgatgcctttcctcagagcaacgctccaattcaagatgaagaaagggacataccagaacgctcatggaattcaggcaatgaatggattaccgacttcgctgggaaaacggtgtggtttgtccctagcattaaagccggaaatgacatagcaaactgcttgcgaaaaaacgggaaaaaagtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggccggaccaatgccagtcaccgcggcgagtgctgcgcaaaggagagggagagttggcaggaacccacaaaaagagaatgaccagtacatattcacgggccagcctctcaacaatgatgaagaccatgctcactggacagaagcaaaaatgctgctggacaacatcaacacaccagaagggattataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatttggacaaaggaaggagaaaagaaaaaattgagacctaggtggcttgatgcccgcacttattcagatccattggcactcaaggaattcaaggactttgcggctggcagaaagtcaatcgcccttgatcttgtgacagaaataggaagagtgccttcacatctagcccacagaacaagaaacgctctggacaatctggtgatgctgcatacgtcagaagatggcggtagggcttacaggcatgcggtggaggaactaccagaaacaatggaaacactcctactcttgggactaatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaacaatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagattctgtaatatttgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagagacaacacatcatgccgtgtcccgaggtagcgcaaaacttcaatggtttgtggaaagaaacatggtcgttcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagcggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggctatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacaggcagttagcgaacgctatattcaagctcacataccaaaacaaagtggtcaaagttcaacgaccgactccaacgggcacggtaatggatattatatctaggaaagaccaaaggggcagtggacaactgggaacttatggcctgaatacattcaccaacatggaagcccagttagtcagacaaatggaaggagaaggtgtgctgacaaaggcagacctcgagaaccctcatctgctagagaagaaaatcacacaatggttggaaaccaaaggagtggagaggttaaaaagaatggccattagcggggatgattgcgtggtgaaaccaatcgatgacaggttcgctaatgccctgcttgctttgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacttgggaaaatgttccatatctaggaaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagtcggagggagccatttggtaaacgtaggaagtggaaaagaggctaactgtcaggccaccttaagccacagtacggaagaagctgtgctgcctgtgagccccgtccaaggacgttaaaagaagaagtcaggccccaaagccacggtttgagcaaaccgtgctgcctgtagctccgtcgtggggacgtaaaacctgggaggctgcaaactgtggaagctgtacgcacggtgtagcagactagcggttagaggagacccctcccatgacacaacgcagcagcggggcccgagcactgagggaagctgtacctccttgcaaaggactagaggttagaggagaccccccgcaaataaaaacagcatattgacgctgggagagaccagagatcctgctgtctcctcagcatcattccaggcacagaacgccagaaaatggaatggtgctgttgaatcaacaggttct

SEQ ID NO: 21 - protein, 3387 aa, Dengue virus
MNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKRSTITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVASWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIVEVKQDEDGSFSIRDVEETNMITLLVKLALITVSGLYPLAIPVTMTLWYMWQVKTQRSGALWDVPSPAATKKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILPDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYEDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 22 - DNA, 10649 bp, Dengue virus
agttgttagtctgtgtggaccgacaaggacagttccaaatcggaagcttgcttaacacagttctaacagtttgtttgaatagagagcagatctctggaaaaatgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgctgtgcttgattcccaccgtaatggcgttttccctcagcacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcgaggaacacttcaatggctatgacgtgcatagctgttggaggaatcactctgtttctgggcttcacagttcaagcagacatgggttgtgtggcgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaacgtgcagtgggatgaaatggcagacataacaggctcaagcccaatcgtagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctacgaactttgattttagctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagccgggagagtgatagaccctagaagatgcctcaagccagttatcctaccagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacgaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatcaagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggttggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtggtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgcggggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggagctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcatacggccataacccaggtcaggaacctgatcggaaaagaggaatacgtggattacatgccagtaatgaaaagatacagtgctccttcagagagtgaaggagttctgtaattaccaacaacaaacaccaaaggctattgaagtcaggccacttgtgccacggtttgagcaaaccgtgctgcctgtagctccgccaataatgggaggcgtaataatccccagggaggccatgcgccacggaagctgtacgcgtggcatattggactagcggttagaggagacccctcccatcactgataaaacgcagcaaaagggggcccgaagccaggaggaagctgtactcctggtggaaggactagaggttagaggagacccccccaacacaaaaacagcatattgacgctgggaaagaccagagatcctgctgtctctgcaacatcaatccaggcacagagcgccgcaagatggattggtgttgttgatccaacaggttct

SEQ ID NO: 23 - protein, 680 aa, Dengue virus
MDAMKRGLCCVLLLCGAVFVSPFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEEGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQA

SEQ ID NO: 24 - DNA, 2049 bp, Dengue virus
atggatgctatgaaaagaggcctgtgttgtgtgttgctgttgtgcggagctgtgtttgtgtcacctttccacctgactacccgcaatggtgagccccatatgattgtgtcgcgccaggagaaggggaagtccctcctgttcaaaactgaaaacggcgtgaacatgtgtaccctgatggccatggaccttggagaactgtgcgaggacaccatcacctacaattgtccgctcctgcgccaaaacgaaccagaagatatcgactgctggtgcaattccacttcaacctgggttacctacggaacttgcaccgccacgggagaacacagaagagaaaagcgctcggtggcgctggtgcctcatgtcggaatgggactggagactcggacggagacttggatgtcctcggagggagcatggaaacatgcccaacggatcgaaacttgggtgctgaggcaccctggattcaccatcatggcagcgatcctcgcctacactataggtactacctactttcaaagggtgctgatcttcattctcctcaccgcagtggccccttcaatgaccatgaggtgcattgggatctcgaaccgggacttcgtcgaaggagtgtccggaggtagctgggtcgacatcgtcctggaacacggaagctgcgtgactactatggcgaagaacaagccaaccttggacttcgagcttatcaagaccgaggcgaagcacccggccactctgagaaagtactgcatcgaggctaagctcaccaacacgaccactgcctcgcgatgcccaactcagggagaaccgtcactgaacgaagaacaggataaacgctttgtgtgcaagcatagcatggtggatagaggctggggaaacggctgtggactcttcggaaagggtggaattgtgacgtgcgcaatgttcacttgcaagaagaatatggaagggaagatcgtccagccggagaacctggaatacactatcgtgatcaccccgcactcaggcgaggagaacgcagtgggcaacgataccgggaagcacgggaaggaaatcaaggtgaccccgcagtcgtccattaccgaggccgaactcaccggatacggcactgtgactatggaatgctcgccacggaccgggctggatttcaatgagatggtgctcttgcaaatggagaacaaagcctggctggtccaccgccagtggttcctcgacctcccccttccgtggctgccgggagctgacacccaaggatccaactggatccaaaaagaaacccttgtcacgtttaagaatccacatgccaaaaagcaggacgtggtcgtgctcggaagccaggaaggagccatgcacactgcgctgactggagcaaccgaaattcaaatgtcgagcggcaacctcctcttcactggacatctgaagtgccggctgcgcatggacaaactgcaacttaagggcatgtcatactcgatgtgtaccggcaaattcaaggtggtgaaggagatcgcggagactcagcacgggaccatcgtcatccgggtccagtatgagggtgatggttccccctgcaagatccctttcgaaatcatggatctggagaaacgtcacgtgctgggccggctgatcactgtgaatccgatcgttacggagaaagacagcccggtgaacatcgaagctgaaccgccgtttggggatagctacattatcatcggcgtggaaccaggccagctcaagttgtcgtggttcaagaaaggatccagcatcggacagatgttcgaaaccactatgcgcggagccaaacgcatggctatcctgggggacacggcctgggacttcgggtcgctgggtggtgtgttcacctccattggaaaggcgctccatcaggtgtttggtgcgatctacggcgccgcattctccggagtgtcatggaccatgaagatcctcatcggagtcgtcatcacctggatcggcatgaattctcggtccacttccttgagcgtcagcctggtgctggtcggagttgtgactctgtaccttggagtgatggtccaggcc

SEQ ID NO: 25 - RNA, 2215 nt, Dengue virus
gggaaauaagagagaaaagaagaguaagaagaaauauaagagccaccauggaugcuaugaaaagaggccuguguuguguguugcuguugugcggagcuguguuugugucaccuuuccaccugacuacccgcaauggugagccccauaugauugugucgcgccaggagaaggggaagucccuccuguucaaaacugaaaacggcgugaacauguguacccugauggccauggaccuuggagaacugugcgaggacaccaucaccuacaauuguccgcuccugcgccaaaacgaaccagaagauaucgacugcuggugcaauuccacuucaaccuggguuaccuacggaacuugcaccgccacgggagaacacagaagagaaaagcgcucgguggcgcuggugccucaugucggaaugggacuggagacucggacggagacuuggauguccucggagggagcauggaaacaugcccaacggaucgaaacuugggugcugaggcacccuggauucaccaucauggcagcgauccucgccuacacuauagguacuaccuacuuucaaagggugcugaucuucauucuccucaccgcaguggccccuucaaugaccaugaggugcauugggaucucgaaccgggacuucgucgaaggaguguccggagguagcugggucgacaucguccuggaacacggaagcugcgugacuacuauggcgaagaacaagccaaccuuggacuucgagcuuaucaagaccgaggcgaagcacccggccacucugagaaaguacugcaucgaggcuaagcucaccaacacgaccacugccucgcgaugcccaacucagggagaaccgucacugaacgaagaacaggauaaacgcuuugugugcaagcauagcaugguggauagaggcuggggaaacggcuguggacucuucggaaaggguggaauugugacgugcgcaauguucacuugcaagaagaauauggaagggaagaucguccagccggagaaccuggaauacacuaucgugaucaccccgcacucaggcgaggagaacgcagugggcaacgauaccgggaagcacgggaaggaaaucaaggugaccccgcagucguccauuaccgaggccgaacucaccggauacggcacugugacuauggaaugcucgccacggaccgggcuggauuucaaugagauggugcucuugcaaauggagaacaaagccuggcugguccaccgccagugguuccucgaccucccccuuccguggcugccgggagcugacacccaaggauccaacuggauccaaaaagaaacccuugucacguuuaagaauccacaugccaaaaagcaggacguggucgugcucggaagccaggaaggagccaugcacacugcgcugacuggagcaaccgaaauucaaaugucgagcggcaaccuccucuucacuggacaucugaagugccggcugcgcauggacaaacugcaacuuaagggcaugucauacucgauguguaccggcaaauucaagguggugaaggagaucgcggagacucagcacgggaccaucgucauccggguccaguaugagggugaugguucccccugcaagaucccuuucgaaaucauggaucuggagaaacgucacgugcugggccggcugaucacugugaauccgaucguuacggagaaagacagcccggugaacaucgaagcugaaccgccguuuggggauagcuacauuaucaucggcguggaaccaggccagcucaaguugucgugguucaagaaaggauccagcaucggacagauguucgaaaccacuaugcgcggagccaaacgcauggcuauccugggggacacggccugggacuucgggucgcugggugguguguucaccuccauuggaaaggcgcuccaucagguguuuggugcgaucuacggcgccgcauucuccggagugucauggaccaugaagauccucaucggagucgucaucaccuggaucggcaugaauucucgguccacuuccuugagcgucagccuggugcuggucggaguugugacucuguaccuuggagugaugguccaggccugauaauaggcuggagccucgguggccaugcuucuugccccuugggccuccccccagccccuccuccccuuccugcacccguacccccguggucuuugaauaaagucugagugggcggc

SEQ ID NO: 26 - protein, 580 aa, Dengue virus
MDAMKRGLCCVLLLCGAVFVSPFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEEGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKG

SEQ ID NO: 27 - DNA, 1749 bp, Dengue virus
atggatgctatgaaaagaggcctgtgttgtgtgttgctgttgtgcggagctgtgtttgtgtcacctttccacctgactacccgcaatggtgagccccatatgattgtgtcgcgccaggagaaggggaagtccctcctgttcaaaactgaaaacggcgtgaacatgtgtaccctgatggccatggaccttggagaactgtgcgaggacaccatcacctacaattgtccgctcctgcgccaaaacgaaccagaagatatcgactgctggtgcaattccacttcaacctgggttacctacggaacttgcaccgccacgggagaacacagaagagaaaagcgctcggtggcgctggtgcctcatgtcggaatgggactggagactcggacggagacttggatgtcctcggagggagcatggaaacatgcccaacggatcgaaacttgggtgctgaggcaccctggattcaccatcatggcagcgatcctcgcctacactataggtactacctactttcaaagggtgctgatcttcattctcctcaccgcagtggccccttcaatgaccatgaggtgcattgggatctcgaaccgggacttcgtcgaaggagtgtccggaggtagctgggtcgacatcgtcctggaacacggaagctgcgtgactactatggcgaagaacaagccaaccttggacttcgagcttatcaagaccgaggcgaagcacccggccactctgagaaagtactgcatcgaggctaagctcaccaacacgaccactgcctcgcgatgcccaactcagggagaaccgtcactgaacgaagaacaggataaacgctttgtgtgcaagcatagcatggtggatagaggctggggaaacggctgtggactcttcggaaagggtggaattgtgacgtgcgcaatgttcacttgcaagaagaatatggaagggaagatcgtccagccggagaacctggaatacactatcgtgatcaccccgcactcaggcgaggagaacgcagtgggcaacgataccgggaagcacgggaaggaaatcaaggtgaccccgcagtcgtccattaccgaggccgaactcaccggatacggcactgtgactatggaatgctcgccacggaccgggctggatttcaatgagatggtgctcttgcaaatggagaacaaagcctggctggtccaccgccagtggttcctcgacctcccccttccgtggctgccgggagctgacacccaaggatccaactggatccaaaaagaaacccttgtcacgtttaagaatccacatgccaaaaagcaggacgtggtcgtgctcggaagccaggaaggagccatgcacactgcgctgactggagcaaccgaaattcaaatgtcgagcggcaacctcctcttcactggacatctgaagtgccggctgcgcatggacaaactgcaacttaagggcatgtcatactcgatgtgtaccggcaaattcaaggtggtgaaggagatcgcggagactcagcacgggaccatcgtcatccgggtccagtatgagggtgatggttccccctgcaagatccctttcgaaatcatggatctggagaaacgtcacgtgctgggccggctgatcactgtgaatccgatcgttacggagaaagacagcccggtgaacatcgaagctgaaccgccgtttggggatagctacattatcatcggcgtggaaccaggccagctcaagttgtcgtggttcaagaaagga

SEQ ID NO: 28 - RNA, 1915 nt, Dengue virus
gggaaauaagagagaaaagaagaguaagaagaaauauaagagccaccauggaugcuaugaaaagaggccuguguuguguguugcuguugugcggagcuguguuugugucaccuuuccaccugacuacccgcaauggugagccccauaugauugugucgcgccaggagaaggggaagucccuccuguucaaaacugaaaacggcgugaacauguguacccugauggccauggaccuuggagaacugugcgaggacaccaucaccuacaauuguccgcuccugcgccaaaacgaaccagaagauaucgacugcuggugcaauuccacuucaaccuggguuaccuacggaacuugcaccgccacgggagaacacagaagagaaaagcgcucgguggcgcuggugccucaugucggaaugggacuggagacucggacggagacuuggauguccucggagggagcauggaaacaugcccaacggaucgaaacuugggugcugaggcacccuggauucaccaucauggcagcgauccucgccuacacuauagguacuaccuacuuucaaagggugcugaucuucauucuccucaccgcaguggccccuucaaugaccaugaggugcauugggaucucgaaccgggacuucgucgaaggaguguccggagguagcugggucgacaucguccuggaacacggaagcugcgugacuacuauggcgaagaacaagccaaccuuggacuucgagcuuaucaagaccgaggcgaagcacccggccacucugagaaaguacugcaucgaggcuaagcucaccaacacgaccacugccucgcgaugcccaacucagggagaaccgucacugaacgaagaacaggauaaacgcuuugugugcaagcauagcaugguggauagaggcuggggaaacggcuguggacucuucggaaaggguggaauugugacgugcgcaauguucacuugcaagaagaauauggaagggaagaucguccagccggagaaccuggaauacacuaucgugaucaccccgcacucaggcgaggagaacgcagugggcaacgauaccgggaagcacgggaaggaaaucaaggugaccccgcagucguccauuaccgaggccgaacucaccggauacggcacugugacuauggaaugcucgccacggaccgggcuggauuucaaugagauggugcucuugcaaauggagaacaaagccuggcugguccaccgccagugguuccucgaccucccccuuccguggcugccgggagcugacacccaaggauccaacuggauccaaaaagaaacccuugucacguuuaagaauccacaugccaaaaagcaggacguggucgugcucggaagccaggaaggagccaugcacacugcgcugacuggagcaaccgaaauucaaaugucgagcggcaaccuccucuucacuggacaucugaagugccggcugcgcauggacaaacugcaacuuaagggcaugucauacucgauguguaccggcaaauucaagguggugaaggagaucgcggagacucagcacgggaccaucgucauccggguccaguaugagggugaugguucccccugcaagaucccuuucgaaaucauggaucuggagaaacgucacgugcugggccggcugaucacugugaauccgaucguuacggagaaagacagcccggugaacaucgaagcugaaccgccguuuggggauagcuacauuaucaucggcguggaaccaggccagcucaaguugucgugguucaagaaaggaugauaauaggcuggagccucgguggccaugcuucuugccccuugggccuccccccagccccuccuccccuuccugcacccguacccccguggucuuugaauaaagucugagugggcggc

SEQ ID NO: 29 - protein, 845 aa, Dengue virus
MDAMKRGLCCVLLLCGAVFVSPFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEEGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGGGGGSGGGGSGGGGSEVKLQQSGTEVVKPGASVKLSCKASGYIFTSYDIDWVRQTPEQGLEWIGWIFPGEGSTEYNEKFKGRATLSVDKSSSTAYMELTRLTSEDSAVYFCARGDYYRRYFDLWGQGTTVTVSSGGGGSGGGGSGGGGSDIQMTQSPSFLSTSLGNSITITCHASQNIKGWLAWYQQKSGNAPQLLIYKASSLQSGVPSRFSGSGSGTDYIFTISNLQPEDIATYYCQHYQSFPWTFGGGTKLEIKRDYKDDDDK

SEQ ID NO: 30 - DNA, 2544 bp, Dengue virus
atggatgctatgaaaagaggcctgtgttgtgtgttgctgttgtgcggagctgtgtttgtgtcacctttccacctgactacccgcaatggtgagccccatatgattgtgtcgcgccaggagaaggggaagtccctcctgttcaaaactgaaaacggcgtgaacatgtgtaccctgatggccatggaccttggagaactgtgcgaggacaccatcacctacaattgtccgctcctgcgccaaaacgaaccagaagatatcgactgctggtgcaattccacttcaacctgggttacctacggaacttgcaccgccacgggagaacacagaagagaaaagcgctcggtggcgctggtgcctcatgtcggaatgggactggagactcggacggagacttggatgtcctcggagggagcatggaaacatgcccaacggatcgaaacttgggtgctgaggcaccctggattcaccatcatggcagcgatcctcgcctacactataggtactacctactttcaaagggtgctgatcttcattctcctcaccgcagtggccccttcaatgaccatgaggtgcattgggatctcgaaccgggacttcgtcgaaggagtgtccggaggtagctgggtcgacatcgtcctggaacacggaagctgcgtgactactatggcgaagaacaagccaaccttggacttcgagcttatcaagaccgaggcgaagcacccggccactctgagaaagtactgcatcgaggctaagctcaccaacacgaccactgcctcgcgatgcccaactcagggagaaccgtcactgaacgaagaacaggataaacgctttgtgtgcaagcatagcatggtggatagaggctggggaaacggctgtggactcttcggaaagggtggaattgtgacgtgcgcaatgttcacttgcaagaagaatatggaagggaagatcgtccagccggagaacctggaatacactatcgtgatcaccccgcactcaggcgaggagaacgcagtgggcaacgataccgggaagcacgggaaggaaatcaaggtgaccccgcagtcgtccattaccgaggccgaactcaccggatacggcactgtgactatggaatgctcgccacggaccgggctggatttcaatgagatggtgctcttgcaaatggagaacaaagcctggctggtccaccgccagtggttcctcgacctcccccttccgtggctgccgggagctgacacccaaggatccaactggatccaaaaagaaacccttgtcacgtttaagaatccacatgccaaaaagcaggacgtggtcgtgctcggaagccaggaaggagccatgcacactgcgctgactggagcaaccgaaattcaaatgtcgagcggcaacctcctcttcactggacatctgaagtgccggctgcgcatggacaaactgcaacttaagggcatgtcatactcgatgtgtaccggcaaattcaaggtggtgaaggagatcgcggagactcagcacgggaccatcgtcatccgggtccagtatgagggtgatggttccccctgcaagatccctttcgaaatcatggatctggagaaacgtcacgtgctgggccggctgatcactgtgaatccgatcgttacggagaaagacagcccggtgaacatcgaagctgaaccgccgtttggggatagctacattatcatcggcgtggaaccaggccagctcaagttgtcgtggttcaagaaaggaggaggtggaggatccggaggcggagggtcgggcggtggtggatcggaggtcaaactgcagcaatcagggaccgaagtcgtgaagccgggggcttcagtcaagctgtcctgcaaggccagcggctatatcttcactagctacgacatcgattgggtgcggcagactccggagcaaggactcgagtggattgggtggatctttccgggcgagggatcaaccgagtacaacgaaaaatttaagggacgggcaacgctgtccgtggacaagagctcatctacggcgtacatggagctgacgcggctcacgtcagaggattccgccgtctacttctgtgccaggggcgactactaccggcgctactttgatctgtggggacaaggaacgaccgtgactgtctcatcaggcggcggcggatcgggaggaggcggatcgggtggcggtggttcggacattcagatgactcaatcgcccagcttcctgtcgacctcactggggaattctattacgatcacttgtcacgcttcgcagaacatcaagggttggctggcttggtaccagcagaaaagcggtaacgccccgcaactgctcatctacaaggcatcgtccctgcaatcgggagtgccgtcacgcttttcaggatcgggctccggaaccgattacatctttaccatcagcaacctgcagccggaagacatcgccacttactactgtcaacactatcagagctttccgtggacctttggaggggggaccaaattggagatcaagcgcgactacaaggatgacgatgacaaa

SEQ ID NO: 31 - RNA, 2710 nt, Dengue virus
gggaaauaagagagaaaagaagaguaagaagaaauauaagagccaccauggaugcuaugaaaagaggccuguguuguguguugcuguugugcggagcuguguuugugucaccuuuccaccugacuacccgcaauggugagccccauaugauugugucgcgccaggagaaggggaagucccuccuguucaaaacugaaaacggcgugaacauguguacccugauggccauggaccuuggagaacugugcgaggacaccaucaccuacaauuguccgcuccugcgccaaaacgaaccagaagauaucgacugcuggugcaauuccacuucaaccuggguuaccuacggaacuugcaccgccacgggagaacacagaagagaaaagcgcucgguggcgcuggugccucaugucggaaugggacuggagacucggacggagacuuggauguccucggagggagcauggaaacaugcccaacggaucgaaacuugggugcugaggcacccuggauucaccaucauggcagcgauccucgccuacacuauagguacuaccuacuuucaaagggugcugaucuucauucuccucaccgcaguggccccuucaaugaccaugaggugcauugggaucucgaaccgggacuucgucgaaggaguguccggagguagcugggucgacaucguccuggaacacggaagcugcgugacuacuauggcgaagaacaagccaaccuuggacuucgagcuuaucaagaccgaggcgaagcacccggccacucugagaaaguacugcaucgaggcuaagcucaccaacacgaccacugccucgcgaugcccaacucagggagaaccgucacugaacgaagaacaggauaaacgcuuugugugcaagcauagcaugguggauagaggcuggggaaacggcuguggacucuucggaaaggguggaauugugacgugcgcaauguucacuugcaagaagaauauggaagggaagaucguccagccggagaaccuggaauacacuaucgugaucaccccgcacucaggcgaggagaacgcagugggcaacgauaccgggaagcacgggaaggaaaucaaggugaccccgcagucguccauuaccgaggccgaacucaccggauacggcacugugacuauggaaugcucgccacggaccgggcuggauuucaaugagauggugcucuugcaaauggagaacaaagccuggcugguccaccgccagugguuccucgaccucccccuuccguggcugccgggagcugacacccaaggauccaacuggauccaaaaagaaacccuugucacguuuaagaauccacaugccaaaaagcaggacguggucgugcucggaagccaggaaggagccaugcacacugcgcugacuggagcaaccgaaauucaaaugucgagcggcaaccuccucuucacuggacaucugaagugccggcugcgcauggacaaacugcaacuuaagggcaugucauacucgauguguaccggcaaauucaagguggugaaggagaucgcggagacucagcacgggaccaucgucauccggguccaguaugagggugaugguucccccugcaagaucccuuucgaaaucauggaucuggagaaacgucacgugcugggccggcugaucacugugaauccgaucguuacggagaaagacagcccggugaacaucgaagcugaaccgccguuuggggauagcuacauuaucaucggcguggaaccaggccagcucaaguugucgugguucaagaaaggaggagguggaggauccggaggcggagggucgggcggugguggaucggaggucaaacugcagcaaucagggaccgaagucgugaagccgggggcuucagucaagcuguccugcaaggccagcggcuauaucuucacuagcuacgacaucgauugggugcggcagacuccggagcaaggacucgaguggauuggguggaucuuuccgggcgagggaucaaccgaguacaacgaaaaauuuaagggacgggcaacgcuguccguggacaagagcucaucuacggcguacauggagcugacgcggcucacgucagaggauuccgccgucuacuucugugccaggggcgacuacuaccggcgcuacuuugaucuguggggacaaggaacgaccgugacugucucaucaggcggcggcggaucgggaggaggcggaucggguggcggugguucggacauucagaugacucaaucgcccagcuuccugucgaccucacuggggaauucuauuacgaucacuugucacgcuucgcagaacaucaaggguuggcuggcuugguaccagcagaaaagcgguaacgccccgcaacugcucaucuacaaggcaucgucccugcaaucgggagugccgucacgcuuuucaggaucgggcuccggaaccgauuacaucuuuaccaucagcaaccugcagccggaagacaucgccacuuacuacugucaacacuaucagagcuuuccguggaccuuuggaggggggaccaaauuggagaucaagcgcgacuacaaggaugacgaugacaaaugauaauaggcuggagccucgguggccaugcuucuugccccuugggccuccccccagccccuccuccccuuccugcacccguacccccguggucuuugaauaaagucugagugggcggc

SEQ ID NO: 32 - protein, 305 aa, Dengue virus
MDWTWILFLVAAATRVHSKGMSYSMCTGKFKVVKEIAETQHGTIVIRVQTEGDGSPCKIPFEIMDLEKRHVLGRLITVNPIVTEKDSPVNIEAEPPFGDSYIIIGVEPGQLKLNWFKKGSSIGQMFETTMRGAKRMAILSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 33 - DNA, 916 bp, Dengue virus
atggattggacctggatcttgtttctcgtcgccgcagccactcgcgttcatagcaaaggaatgtcatactccatgtgcacgggaaaattcaaggtggtcaaagagatcgcggagactcagcacggcaccatcgtcattcgcgtgcaaactgaaggagatggatctccctgcaagatcccgttcgagatcatggacctggaaaagagacacgtcctcggtagactgatcaccgtgaacccgatcgtgacggagaaggattccccggtgaatattgaagcagagcctccatttggggactcatacattatcattggggtcgagccgggccagctgaagctgaattggtttaagaagggctcgtcaatcggacagatgttcgaaactactatgaggggtgcaaagcggatggcgatcctctcgggcggagatatcatcaaactccttaacgaacaggtgaacaaggagatgcagtcctcaaacctttacatgagcatgtcgtcctggtgttacacccatagcctggacggcgctggattgttcctgtttgaccatgcagcggaggaatacgaacacgccaagaagctcatcatcttcctgaacgagaataacgtgccagtgcaactgacctccatctcggctcctgagcacaagttcgaaggactcacccagatcttccaaaaggcctacgaacacgaacagcacatcagcgaatccatcaacaatatcgtggaccatgctatcaaaagcaaagaccatgcgaccttcaacttcctgcaatggtatgtcgccgaacagcacgaagaggaggtgctgttcaaggacattctcgacaaaatcgaattgatagggaacgaaaatcacggtctgtacctggccgatcaatacgtgaagggaattgccaagtcgcggaagtcgt

SEQ ID NO: 34 - RNA, 1082 nt, Dengue virus
gggaaauaagagagaaaagaagaguaagaagaaauauaagagccaccauggauuggaccuggaucuuguuucucgucgccgcagccacucgcguucauagcaaaggaaugucauacuccaugugcacgggaaaauucaagguggucaaagagaucgcggagacucagcacggcaccaucgucauucgcgugcaaacugaaggagauggaucucccugcaagaucccguucgagaucauggaccuggaaaagagacacguccucgguagacugaucaccgugaacccgaucgugacggagaaggauuccccggugaauauugaagcagagccuccauuuggggacucauacauuaucauuggggucgagccgggccagcugaagcugaauugguuuaagaagggcucgucaaucggacagauguucgaaacuacuaugaggggugcaaagcggauggcgauccucucgggcggagauaucaucaaacuccuuaacgaacaggugaacaaggagaugcaguccucaaaccuuuacaugagcaugucguccugguguuacacccauagccuggacggcgcuggauuguuccuguuugaccaugcagcggaggaauacgaacacgccaagaagcucaucaucuuccugaacgagaauaacgugccagugcaacugaccuccaucucggcuccugagcacaaguucgaaggacucacccagaucuuccaaaaggccuacgaacacgaacagcacaucagcgaauccaucaacaauaucguggaccaugcuaucaaaagcaaagaccaugcgaccuucaacuuccugcaaugguaugucgccgaacagcacgaagaggaggugcuguucaaggacauucucgacaaaaucgaauugauagggaacgaaaaucacggucuguaccuggccgaucaauacgugaagggaauugccaagucgcggaagucgugauaauaggcuggagccucgguggccaugcuucuugccccuugggccuccccccagccccuccuccccuuccugcacccguacccccguggucuuugaauaaagucugagugggcggcu

SEQ ID NO: 35 - protein, 140 aa, Artificial Sequence
  Synthetic Polypeptide
GKPIPNPLLGLDSTGFLGGKPIPNPLLGLDSTGFLGGKPIPNPLLGLDSTGFLGGKPIPNPLLGLDSTGFLGGKPIPNPLLGLDSTGFLGGKPIPNPLLGLDSTGFLGGKPIPNPLLGLDSTGFLGGKPIPNPLLGLDST

SEQ ID NO: 36 - protein, 140 aa, Artificial Sequence; identical to SEQ ID NO: 35
  Synthetic Polypeptide

SEQ ID NO: 37 - protein, 440 aa, Chikungunya virus
MYEHVTVIPNTVGVPYKTLVNRPGYSPMVLEMELLSVTLEPTLSLDYITCEYKTVIPSPYVKCCGTAECKDKSLPDYSCKVFTGVYPFMWGGAYCFCDTENTQLSEAHVEKSESCKTEFASAYRAHTASASAKLRVLYQGNNITVAAYANGDHAVTVKDAKFIVGPMSSAWTPFDNKIVVYKGDVYNMDYPPFGAGRPGQFGDIQSRTPESEDVYANTQLVLQRPSAGTVHVPYSQAPSGFKYWLKERGASLQHTAPFGCQIATNPVRAMNCAVGNMPISIDIPDAAFTRVVDAPSLTDMSCEVSACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 38 - protein, 440 aa, Chikungunya virus
MYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNMPISIDIPDAAFIRVVDAPSLTDMSCEVPACTHSSDFGGVAIIKYAASKKGKCAVHSMTNAVTIREAEIEVEGNSQLQISFSTALASAEFRVQVCSTQVHCVAECHPPKDHIVNYPASHTTLGVQDISATALSWVQKITGGVGLVVAVAALILIVVLCVSFSRH

SEQ ID NO: 39 - protein, 1726 aa, Chikungunya virus
MSIKDHFNVYKATRPYLAHCPDCGEGHSCHSPVALERIRNEATDGTLKIQVSLQIGIKTDDSHDWTKLRYMDNHMPADAERAGLFVRTSAPCTITGTMGHFILARCPKGETLTVGFTDGRKISHSCTHPFHHDPPVIGREKFHSRPQHGRELPCSTYAQSTAATAEEIEVHMPPDTPDRTLMSQQSGNVKITVNSQTVRYKCNCGDSSEGLTTTDKVINNCKVDQCHAAVTNHKKWQYNSPLVPRNAEFGDRKGKVHIPFPLANVTCRVPKARNPTVTYGKNQVIMLLYPDHPTLLSYRNMGEEPNYQEEWVTHKKEIRLTVPTEGLEVTWGNNEPYKYWPQLSTNGTAHGHPHEIILYYYELYPTMTAVVLSVASFILLSMVGVAVGMCMCARRRCITPYELTPGATVPFLLSLICCIRTAKAYEHVTVIPNTVGVPYKTLVNRPGYSPMVLEMELLSVTLEPTLSLDYITCEYKTVIPSPYVKCCGTAECKDKSLPDYSCKVFTGVYPFMWGGAYCFCDTENTQLSEAHVEKSESCKTEFASAYRAHTASASAKLRVLYQGNNITVAAYANGDHAVTVKDAKFIVGPMSSAWTPFDNKIVVYKGDVYNMDYPPFGAGRPGQFGDIQSRTPESEDVYANTQLVLQRPSAGTVHVPYSQAPSGFKYWLKERGASLQHTAPFGCQIATNPVRAMNCAVGNMPISIDIPDAAFTRVVDAPSLTDMSCEVSACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRHMSIKDHFNVYKATRPYLAHCPDCGEGHSCHSPVALERIRNEATDGTLKIQVSLQIGIKTDDSHDWTKLRYMDNHMPADAERAGLFVRTSAPCTITGTMGHFILARCPKGETLTVGFTDGRKISHSCTHPFHHDPPVIGREKFHSRPQHGRELPCSTYAQSTAATAEEIEVHMPPDTPDRTLMSQQSGNVKITVNSQTVRYKCNCGDSSEGLTTTDKVINNCKVDQCHAAVTNHKKWQYNSPLVPRNAEFGDRKGKVHIPFPLANVTCRVPKARNPTVTYGKNQVIMLLYPDHPTLLSYRNMGEEPNYQEEWVTHKKEIRLTVPTEGLEVTWGNNEPYKYWPQLSTNGTAHGHPHEIILYYYELYPTMTAVVLSVASFILLSMVGVAVGMCMCARRRCITPYELTPGATVPFLLSLICCIRTAKAYEHVTVIPNTVGVPYKTLVNRPGYSPMVLEMELLSVTLEPTLSLDYITCEYKTVIPSPYVKCCGTAECKDKSLPDYSCKVFTGVYPFMWGGAYCFCDTENTQLSEAHVEKSESCKTEFASAYRAHTASASAKLRVLYQGNNITVAAYANGDHAVTVKDAKFIVGPMSSAWTPFDNKIVVYKGDVYNMDYPPFGAGRPGQFGDIQSRTPESEDVYANTQLVLQRPSAGTVHVPYSQAPSGFKYWLKERGASLQHTAPFGCQIATNPVRAMNCAVGNMPISIDIPDAAFTRVVDAPSLTDMSCEVSACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 40 - protein, 863 aa, Chikungunya virus
MSTKDNFNVYKATRPYLAHCPDCGEGHSCHSPVALERIRNEATDGTLKIQVSLQIGIKTDDSHDWTKLRYMDNHTPADAERAGLFVRTSAPCTITGTMGHFILTRCPKGETLTVGFTDSRKISHSCTHPFHHDPPVIGREKFHSRPQHGKELPCSTYVQSTAATTEEIEVHMPPDTPDRTLMSQQSGNVKITVNGQTVRYKCNCGGSNEGLITTDKVINNCKVDQCHAAVTNHKKWQYNSPLVPRNAELGDRKGKIHIPFPLANVTCRVPKARNPTVTYGKNQVIMLLYPDHPTLLSYRNMGEEPNYQEEWVTHKKEVVLTVPTEGLEVTWGNNEPYKYWPQLSTNGTAHGHPHEIILYYYELYPTMTVVVVSVASFVLLSMVGVAVGMCMCARRRCITPYELTPGATVPFLLSLICCIRTAKAYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNMPISIDIPDAAFIRVVDAPSLTDMSCEVPACTHSSDFGGVAIIKYAASKKGKCAVHSMTNAVTIREAEIEVEGNSQLQISFSTALASAEFRVQVCSTQVHCVAECHPPKDHIVNYPASHTTLGVQDISATALSWVQKITGGVGLVVAVAALILIVVLCVSFSRH

SEQ ID NO: 41 - protein, 424 aa, Chikungunya virus
MSIKDHFNVYKATRPYLAHCPDCGEGHSCHSPVALERIRNEATDGTLKIQVSLQIGIKTDDSHDWTKLRYMDNHMPADAERAGLFVRTSAPCTITGTMGHFILARCPKGETLTVGFTDGRKISHSCTHPFHHDPPVIGREKFHSRPQHGRELPCSTYAQSTAATAEEIEVHMPPDTPDRTLMSQQSGNVKITVNSQTVRYKCNCGDSSEGLTTTDKVINNCKVDQCHAAVTNHKKWQYNSPLVPRNAEFGDRKGKVHIPFPLANVTCRVPKARNPTVTYGKNQVIMLLYPDHPTLLSYRNMGEEPNYQEEWVTHKKEIRLTVPTEGLEVTWGNNEPYKYWPQLSTNGTAHGHPHEIILYYYELYPTMTAVVLSVASFILLSMVGVAVGMCMCARRRCITPYELTPGATVPFLLSLICCIRTAKA

SEQ ID NO: 42 - protein, 424 aa, Chikungunya virus
MSTKDNFNVYKATRPYLAHCPDCGEGHSCHSPVALERIRNEATDGTLKIQVSLQIGIKTDDSHDWTKLRYMDNHTPADAERAGLFVRTSAPCTITGTMGHFILTRCPKGETLTVGFTDSRKISHSCTHPFHHDPPVIGREKFHSRPQHGKELPCSTYVQSTAATTEEIEVHMPPDTPDRTLMSQQSGNVKITVNGQTVRYKCNCGGSNEGLITTDKVINNCKVDQCHAAVTNHKKWQYNSPLVPRNAELGDRKGKIHIPFPLANVTCRVPKARNPTVTYGKNQVIMLLYPDHPTLLSYRNMGEEPNYQEEWVTHKKEVVLTVPTEGLEVTWGNNEPYKYWPQLSTNGTAHGHPHEIILYYYELYPTMTVVVVSVASFVLLSMVGVAVGMCMCARRRCITPYELTPGATVPFLLSLICCIRTAKA

SEQ ID NO: 43 - protein, 1248 aa, Chikungunya virus
MEFIPTQTFYNRRYQPRPWAPRPTIQVIRPRPRPQRQAGQLAQLISAVNKLTMRAVPQQKPRRNRKNKKQRQKKQAPQNDPKQKKQPPQKKPAQKKKKPGRRERMCMKIENDCIFEVKHEGKVMGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLALPVLCLLANTTFPCSQPPCTPCCYEKEPESTLRMLEDNVMRPGYYQLLKASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYYEAAAYLWNEQQPLFWLQALIPLAALIVLCNCLKLLPCCCKTLAFLAVMSIGAHTVSAYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 44 - protein, 1247 aa, Chikungunya virus
EFIPTQTFYNRRYQPRPWAPRPTIQVIRPRPRPQRQAGQLAQLISAVNKLTMRAVPQQKPRRNRKNKKQRQKKQAPQNDPKQKKQPPQKKPAQKKKKPGRRERMCMKIENDCIFEVKHEGKVMGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLALPVLCLLANTTFPCSQPPCTPCCYEKEPESTLRMLEDNVMRPGYYQLLKASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYYEAAAYLWNEQQPLFWLQALIPLAALIVLCNCLKLLPCCCKTLAFLAVMSIGAHTVSAYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 45 - protein, 440 aa, Chikungunya virus
MYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 46 - protein, 924 aa, Chikungunya virus
MSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYYEAAAYLWNEQQPLFWLQALIPLAALIVLCNCLKLLPCCCKTLAFLAVMSIGAHTVSAYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 47 - protein, 424 aa, Chikungunya virus
MSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKA

SEQ ID NO: 48 - DNA, 10254 bp, Zika virus
atgaaaaacccaaagaagaaatccggaggattccggattgtcaatatgctaaaacgcggagtagcccgtgtaaaccccttgggaggtttgaagaggctgccagccggacttctgctgggtcatggacccatcagaatggttttggcgatattagcctttttgagattcacagcaatcaagccatcactgggcctcatcaacagatggggtaccgtggggaaaaaagaggctatggaaataataaaaaaatttaagaaagatcttgctgccatgttgagaataatcaatgctaggaaggagaggaagagacgtggcgcagacaccagcatcggaatcgttggcctcctgttgactacagccatggcagcagagatcactagacgtgggagtgcatactacatgtacttggataggagcgatgcagggaaggccatttctttcgctaccacattgggggtgaacaaatgccatgtgcagatcatggacctcgggcacatgtgtgacgccaccatgagctatgaatgccctatgctggacgagggggtggaaccagatgacgtcgattgctggtgcaacacgacatcaacttgggttgtgtacggaacctgtcatcataaaaaaggtgaagcacggcgatctagaagagccgtcacgctcccatctcactccacaaggaaattgcaaacgcggtcgcagacttggctagaatcaagagaatacacaaagcacctgatcaaggttgaaaattggatattcaggaaccctggttttacgctagtggctgtcgccatcgcctggcttttgggaagctcgacgagccaaaaagtcatatacttggtcatgatactgctgattgccccggcatacagtatcaggtgcataggagtcagcaatagagacttcgtggagggcatgtcaggtgggacctgggttgacgttgtcctggaacatggaggctgcgtcaccgtgatggcacaggacaagccaacagttgacatagagctggtcacaacaacggttagtaacatggccgaggtgagatcctattgttacgaggcatcaatatcggacatggcttcggacagtcgctgcccaacacaaggtgaagcctaccttgacaagcaatcagacactcaatatgtttgcaaaagaacattggtggacagaggttggggaaatgggtgtggactctttggcaaagggagtttggtgacatgtgctaagttcacgtgctccaagaagatgactgggaagagcattcagccggagaacctggagtatcggataatgctatcagtgcatggctcccagcacagtgggatgattgttaatgatgaaaacagagcgaaggtcgaggttacgcccaattcaccaagagcagaagcaaccctgggaggctttggaagcttaggacttgattgtgaaccaaggacaggccttgacttttcagatctgtattacctaaccatgaataacaagcattggttggtgcacaaagagtggtttcatgacatcccattgccctggcatgctggggcagacactggaactccacattggaacaacaaggaggcattagtggaattcaaggacgcccacgccaagaggcaaaccgtcgtggttttggggagccaggaaggagccgtccacacggctcttgctggagctctagaggctgagatggatggtgcaaagggaaggctattctctggccacttgaaatgtcgcttaaaaatggacaagcttagattgaagggcgtgtcatattccttgtgcaccgcggcattcacattcaccaaggtcccggctgaaacactacatggaacagtcacagtggaggtgcagtatgcagggacagatggaccctgcaaggtcccagcccagatggcggtggacatgcagaccttgaccccagtcggaaggctgataaccgccaaccccgtgattactgaaagcactgagaattcaaagatgatgttggagctcgacccaccatttggggattcttacattgtcataggagttggggataagaaaatcacccatcactggcataggagtggcagcaccattggaaaagcatttgaagccactgtgagaggcgctaagagaatggcagtcctgggggacacagcttgggactttggatcagtcggaggtgtgtttaactcattgggcaagggcattcatcagatttttggagcagctttcaaatcactgtttggaggaatgtcctggttctcacagatcctcataggcactctgctggtgtggttaggtctgaacacaaagaatgggtctatctccctcacatgcttagccctggggggagtgatgatcttcctctccacggctgtttctgctgacgtggggtgctcggtggacttctcaaaaaaagaaacgagatgtggcacgggggtgttcgtctacaatgacgttgaagcctggagggaccggtacaagtaccatcctgactcccctcgtagactggcagcagccgttaagcaagcttgggaagaggggatttgtgggatctcctctgtttctagaatggaaaacataatgtggaaatcagtggaaggagagctcaatgcaatcctagaggagaatggagtccaactgacagttgttgtgggatctgtaaaaaaccccatgtggagaggcccacaaagattgccagtgcctgtgaatgagctgccccatggctggaaagcctgggggaaatcgtactttgttagggcggcaaagaccaacaacagttttgttgtcgacggtgacacattgaaggaatgtccgctcaagcacagagcatggaacagcttcctcgtggaggatcacgggtttggggtcttccacaccagtgtttggcttaaggttagagaagattactcactggagtgtgacccagccgtcataggaacagctgttaagggaaaggaggccgcgcacagtgatctaggctattggattgaaagtgaaaagaatgacacatggaggctgaagagggctcatttgattgagatgaaaacatgtgagtggccaaagtctcacacactgtggacagatggagtggaagaaagtgatctgatcatacccaagtctttagctggtccactcagccaccacaacaccagagagggttacagaactcaagtgaaagggccatggcatagtgaggagcttgaaatccgatttgaggaatgtccaggtaccaaggttcatgtggaggagacatgcggaacgagaggaccatctctgagatcaaccactgcaagcggaagggtcattgaggaatggtgctgtagggaatgcacaatgcccccactatcgttccgagcaaaagatggctgctggtatggaatggagataaggcctaggaaagaaccagagagcaacttagtgaggtcaatggtgacagcgggatcaaccgatcatatggatcatttttctcttggagtgcttgtgattctactcatggtgcaggaagggttgaagaagagaatgaccacaaagatcatcatgagcacatcaatggcagtgctggtggccatgatcttgggaggattctcaatgagtgacctggctaagcttgtgatcctgatgggggccactttcgcagaaatgaacactggaggagacgtagctcacttggcattagtagcggcatttaaagtcagaccagccttgctggtctcatttatcttcagagccaactggacacctcgtgagagcatgctgctagccttggcttcgtgtcttctgcaaactgcgatctccgctcttgaaggcgacttgatggtcctcgttaatggatttgctttggcctggttggcaatacgtgcaatggccgtgccacgcactgacaacatcgctctagcaattctggctgctctaacaccactagcccgaggcacactgctcgtggcatggagagcgggcctcgccacttgtggagggttcatgctcctctccctgaaagggaaaggtagtgtgaagaagaacctgccattcgtcgcggccttgggattgaccgctgtgagaatagtggaccccattaatgtggtgggactactgttactcacaaggagtgggaagcggagctggccccctagtgaagtgctcactgctgtcggcctgatatgtgcattggccggagggtttgccaaggcagacatagagatggctgggcccatggcggcagtgggcctgctaattgtcagttatgtggtctcgggaaagagtgtagatatgtacattgaaagagcaggtgacatcacatgggagaaagacgcggaagtcactggaaacagtcctcggcttgacgtggcactagatgagagtggtgatttctctctggtggaggaagatggtccacccatgagagagatcatacttaaggtggtcttgatggccatctgtggcatgaacccaatagccataccttttgctgcaggagcgtggtatgtgtatgtgaagactgggaaaaggagtggtgccctctgggacgtgcctgctccgaaagaagtgaaaaaaggagagaccacagatggagtgtacagagtgatgactcgcagactgctgggttcaacacaagttggagtgggagtcatgcaggagggagtcttccacaccatgtggcacgtcacaaaaggggccgcattgaggagcggtgaagggagacttgatccatactggggggatgtcaagcaggacttggtgtcatattgtgggccttggaagctggacgcagcttgggacggagttagtgaggtgcagcttctggccgtaccccctggagagagagccagaaacattcagactctgcctggaatatttaagacaaaggatggggacatcggagcagttgctttggactatcctgcaggaacctcaggatctccgatcctagacaaatgcgggagagtgataggactctatggcaatggggttgtgatcaagaacggaagctatgttagtgctataacccagggaaagagggaggaggagactccggttgagtgttttgaaccctcgatgctgaagaagaagcagctaactgtcctggacctgcatccaggggctgggaaaaccaggagagttcttcctgaaatagtccgtgaagctataaagaagagactccgcacggtgatcttggcaccaaccagggtcgtcgctgctgagatggaggaagccctgagaggacttccggtgcgttacatgacaacagcagtcaaggtcacccattctgggacagaaatcgttgatttgatgtgccatgccaccttcacttcacgcctactacaacccattagagtccctaattacaacctctacatcatggatgaagcccatttcacagacccctcaagcatagctgcaagaggatatatatcaacaagggttgagatgggcgaggcagcagccatctttatgactgccacaccaccaggaacccgcgatgcgtttccagattccaactcaccaatcatggacacagaagtggaagtcccagagagagcctggagctcaggctttgattgggtgacggaccattctgggaaaacagtttggttcgttccaagcgtgaggaatggaaatgaaatcgcagcctgtctgacaaaggctggaaagcgggttatacagcttagtaggaaaacttttgagacagagtttcagaaaacaaaaaatcaagagtgggactttgtcataacaactgacatctcagagatgggtgccaacttcaaggctgaccgggttatagattccaggagatgcctaaagccagttatacttgatggtgagagagtcatcttggctgggcccatgcctgtcacgcatgctagcgctgctcagaggagaggacgtataggcaggaaccccaacaagcctggagatgagtacatgtatggaggtgggtgtgcggagactgatgaagaccatgcacattggcttgaagcaagaatgcttcttgacaacatttacctccaggatggcctcatagcctcgctctatcgacctgaggccgacaaggtagccgccattgagggagagtttaagctgaggacagagcaaaggaagacctttgtggaactcatgaagagaggagatcttcccgtttggttggcctaccaggttgcatctgccggaataacttatacagacagaagatggtgttttgatggcacaaccaacaacaccataatggaagacagtgtaccagcagaggtgtggaccaagtatggagagaagagagtgctcaaaccaagatggatggacgccagggtctgctcagatcatgcggccctgaagtcgttcaaagaattcgccgctgggaaaagaggagcggctttgggagtaatggaggccctgggaacattaccaggacacatgacagagaggtttcaggaagccattgataacctcgctgtgctcatgcgagcagagactggaagcaggccctacaaggcagcggcagcccaattgccggagaccctagagaccatcatgcttttaggcctgctgggaacagtatcgctggggatcttttttgtcttgatgaggaacaagggcatcgggaagatgggctttgaaatggtaacccttggggccagcgcatggctcatgtggctctcagaaatcgaaccagccagaattgcatgtgtccttattgttgtgtttttattactggtggtgctaataccagagccagagaagcaaagatccccccaggacaatcagatggcaatcattattatggtggcagtgggccttttggggttgataactgcaaatgaacttggatggctggagagaacaaaaaatgacatagctcatctgatgggaaagagagaagagggaacaaccgtgggattctcaatggacatcgatctgcgaccagcctccgcatgggctatttatgccgcattgacaaccctcatcaccccagccgtccagcacgcggtaactacctcgtacaacaactactccttaatggcgatggccacacaagctggagtgctgtttggcatgggcaaagggatgccattttatgcatgggacttaggagtcccgttgctaatgatgggctgctactcacaactaacacccctgaccctgatagtagccatcattttgcttgtggcacattacatgtacttgatcccaggcctacaggcagcagcagcacgcgctgcccagaagagaacagcagccggcatcatgaagaatcccgttgtggatggaatagtggtaactgacattgacacaatgacaattgacccccaagtggagaagaagatgggacaagtgctacttatagcagtggctgtctccagtgctgtgttgctgcggaccgcttggggatggggggaggctggagctttgatcacagcagcaacttccaccctgtgggaaggctccccaaacaaatactggaactcctccacagccacctcactgtgcaacatcttcagaggaagttacttggcaggagcttcccttatttacacagtgacaagaaatgccggcctggttaagagacgtggaggtggaacgggagaaactctgggagagaagtggaaagcccgcctgaatcagatgtcggccttggagttctactcttacaaaaagtcaggcatcactgaagtatgtagagaggaggctcgccgcgccctcaaggatggagtggccacaggaggacatgctgtatcccgaggaagcgcaaaactcagatggttggtggagagaggatatctgcagccctatggaaaggttgttgatctcggatgcggcagagggggctggagttattatgccgccaccatccgcaaagtgcaggaggtgagaggatacacaaagggaggtcccggtcatgaagagcccatgctggtgcaaagctatgggtggaacataattcgtctcaagagtggagtggacgtcttccacatggcggctgagtcgtgtgacactttgctgtgtgacataggtgagtcatcatccagtcctgaagtggaggagacgcgaacactcagagtgctctccatggtgggggactggcttgagaagagaccaggggccttctgcataaaggtgttatgcccatacaccagcaccatgatggagaccatggagcgactgcaacgtaggtatgggggaggactagtcagagtgccactgtcccgcaattctacacatgagatgtattgggtctctggagcaaaaagtaacatcataaaaagtgtgtccaccacaagtcagctcctcctgggacgcatggatgggcccaggaggccagtgaagtatgaggaggatgtgaacctcggctcaggcacacgagctgtggcaagctgtgctgaggctcccaacatgaaggtcattggtaggcgcattgagagaatccgtagtgaacatgcagaaacatggttctttgatgaaaaccatccatacaggacatgggcctaccacgggagctacgaagcccccacgcaagggtcagcatcttccctcgtgaatggggttgttagactcctgtcaaagccctgggatgtggtgactggagttacaggaatagctatgactgacaccacaccgtacggccaacaaagagtcttcaaagaaaaagtggacaccagggtgccagaccctcaagaaggtactcgccaggtaatgaacatggtcgcttcctggctgtggaaggagctgggaaaacgtaagcggccacgtgtctgcaccaaagaagagttcatcaacaaggtgcgcagcaatgcagcactgggagcaatatttgaagaggaaaaagaatggaagacggctgtggaagctgtgaatgatccaaggttttgggccctagtggataaggaaagagaacaccacctgagaggagagtgccatagttgtgtgtacaacatgatgggaaaaagagaaaagaagcaaggggaattcgggaaagcaaaaggcagtcgcgccatctggtacatgtggttgggagccagattcttggagtttgaagcccttggattcttgaacgaggaccattggatgggaagagaaaactcaggaggtggtgtcgaagggttgggactgcaaagacttggatacgttctagaagaaatgagccgggcaccaggaggaaagatgtatgcagatgacaccgctggctgggacacccgcattagcaagtttgatttggagaatgaagccttgattactaaccaaatggatgaagggcacagaactctggcgttggccgtgattaagtacacataccaaaacaaagtggtgaaggtcctcagaccagctgaaggaggaaaaacagtcatggacatcatttcaagacaagaccagagggggagcggacaagttgtcacttatgctctcaacacatttaccaacttggtggtgcagctcatccggaacatggaggctgaggaagtgttagagatgcaagacttatggctgttgaggaagccagagaaagtaaccagatggctgcagagtagcggatgggacagactcaaacgaatggcagtcagtggtgatgactgtgttgtaaagccaattgatgacaggtttgcacacgccctcaggttcttgaatgatatggggaaagttaggaaagacacacaggaatggaaaccctcaactggatggagcaactgggaagaagtcccgttctgctcccaccactttaacaagctgcacctcaaagacgggagatccattgtggtcccttgccgccaccaagatgaactgattggccgggctcgcgtttcgccgggggcaggatggagcatccgggagactgcctgtcttgcaaaatcatatgcacagatgtggcagcttctttatttccacagaagagacctccgactgatggccaatgccatttgctcggccgtgccagttgactgggtcccaactgggagaactacctggtcaatccatggaaagggagaatggatgactactgaggacatgctcatggtgtggaatagagtgtggattgaggagaatgatcacatggaggacaagacccctgtaacaaaatggacagacattccctatttgggaaaaagggaggacttatggtgtggatcccttataggacacagacctcgcaccacttgggctgagaacatcaaagacacagtcagcatggtgcgcagaatcataggtgatgaagaaaagtacatggactacctatccactcaagttcgctacttgggtgaggaagggtctacacctggagtgctgtaa

SEQ ID NO: 49 - DNA, 2281 bp, Zika virus
tcaagcttttggaccctcgtacagaagctaatacgactcactatagggaaataagagagaaaagaagagtaagaagaaatataagagccaccatggactggacctggatcctgttcctggtggccgctgccacaagagtgcacagcgtggaagtgaccagacggggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcctgataataggctggagcctcggtggccatgcttcttgccccttgggcctccccccagcccctcctccccttcctgcacccgtacccccgtggtctttgaataaagtctgagtgggcggc

SEQ ID NO: 50 - DNA, 2070 bp, Zika virus
atggactggacctggatcctgttcctggtggccgctgccacaagagtgcacagcgtggaagtgaccagacggggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcc

SEQ ID NO: 51 - DNA, 2342 bp, Zika virus
ggggaaataagagagaaaagaagagtaagaagaaatataagagccaccatggactggacctggatcctgttcctggtggccgctgccacaagagtgcacagcgtggaagtgaccagacggggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 52 - DNA, 2272 bp, Zika virus
tcaagcttttggaccctcgtacagaagctaatacgactcactatagggaaataagagagaaaagaagagtaagaagaaatataagagccaccatggactggacctggatcctgttcctggtggccgctgccacaagagtgcacagcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcctgataataggctggagcctcggtggccatgcttcttgccccttgggcctccccccagcccctcctccccttcctgcacccgtacccccgtggtctttgaataaagtctgagtgggcggc

SEQ ID NO: 53 - DNA, 2061 bp, Zika virus
atggactggacctggatcctgttcctggtggccgctgccacaagagtgcacagcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcc

SEQ ID NO: 54 - DNA, 2333 bp, Zika virus
ggggaaataagagagaaaagaagagtaagaagaaatataagagccaccatggactggacctggatcctgttcctggtggccgctgccacaagagtgcacagcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 55 - DNA, 2287 bp, Zika virus
tcaagcttttggaccctcgtacagaagctaatacgactcactatagggaaataagagagaaaagaagagtaagaagaaatataagagccaccatggaaacccctgcccagctgctgttcctgctgctgctgtggctgcctgataccaccggcgtggaagtgaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggc

SEQ ID NO: 56 - DNA, 2076 bp, Zika virus
atggaaacccctgcccagctgctgttcctgctgctgctgtggctgcctgataccaccggcgtggaagtgaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcc

SEQ ID NO: 57 - DNA, 2348 bp, Zika virus
ggggaaataagagagaaaagaagagtaagaagaaatataagagccaccatggaaacccctgcccagctgctgttcctgctgctgctgtggctgcctgataccaccggcgtggaagtgaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 58 - DNA, 2278 bp, Zika virus
tcaagcttttggaccctcgtacagaagctaatacgactcactatagggaaataagagagaaaagaagagtaagaagaaatataagagccaccatggaaacccctgcccagctgctgttcctgctgctgctgtggctgcctgataccaccggcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggc

SEQ ID NO: 59 - DNA, 2067 bp, Zika virus
atggaaacccctgcccagctgctgttcctgctgctgctgtggctgcctgataccaccggcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcc

SEQ ID NO: 60 - DNA, 2339 bp, Zika virus
ggggaaataagagagaaaagaagagtaagaagaaatataagagccaccatggaaacccctgcccagctgctgttcctgctgctgctgtggctgcctgataccaccggcaccagaagaggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccactccaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcaccgcagcggcagcacaatcggcaaggcctttgaagccacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 61 - DNA, 1783 bp, Zika virus
tcaagcttttggaccctcgtacagaagctaatacgactcactatagggaaataagagagaaaagaagagtaagaagaaatataagagccaccatggaaacccctgcccagctgctgttcctgctgctgctgtggctgcctgacaccaccggcatcagatgcatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggacaagcagagcgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgagcagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcaggctgatcacagccaaccctgtgatcaccgagagcaccgagaacagcaagatgatgctggaactggacccccccttcggcgactcctacatcgtgatcggcgtgggagagaagaagatcacccaccactggcacagaagcggcagcaccatcggcaaggcctttgaggctacagtgcggggagccaagagaatggccgtgctgggagataccgcctgggactttggctctgtgggcggagccctgaactctctgggcaagggaatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggc

SEQ ID NO: 62 - DNA, 1572 bp, Zika virus
atggaaacccctgcccagctgctgttcctgctgctgctgtggctgcctgacaccaccggcatcagatgcatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggacaagcagagcgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgagcagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcaggctgatcacagccaaccctgtgatcaccgagagcaccgagaacagcaagatgatgctggaactggacccccccttcggcgactcctacatcgtgatcggcgtgggagagaagaagatcacccaccactggcacagaagcggcagcaccatcggcaaggcctttgaggctacagtgcggggagccaagagaatggccgtgctgggagataccgcctgggactttggctctgtgggcggagccctgaactctctgggcaagggaatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcc

SEQ ID NO: 63 - DNA, 1844 bp, Zika virus
ggggaaataagagagaaaagaagagtaagaagaaatataagagccaccatggaaacccctgcccagctgctgttcctgctgctgctgtggctgcctgacaccaccggcatcagatgcatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggacaagcagagcgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgagcagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcaggctgatcacagccaaccctgtgatcaccgagagcaccgagaacagcaagatgatgctggaactggacccccccttcggcgactcctacatcgtgatcggcgtgggagagaagaagatcacccaccactggcacagaagcggcagcaccatcggcaaggcctttgaggctacagtgcggggagccaagagaatggccgtgctgggagataccgcctgggactttggctctgtgggcggagccctgaactctctgggcaagggaatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggaggcgtgctgatctttctgagcaccgccgtgtctgcctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 64 - DNA, 2088 bp, Artificial Sequence
  Synthetic Polynucleotide
atgctgggcagcaacagcggccagagagtggtgttcaccatcctgctgctgctggtggcccctgcctacagcgccgaagtgacaagaagaggcagcgcctactacatgtacctggaccggaacgatgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaataccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggctgccgctgctattgcttggctgctgggctctagcaccagccagaaagtgatctacctcgtgatgatcctgctgatcgccccagcctactccatccggtgtatcggcgtgtccaaccgggacttcgtggaaggcatgagcggcggcacatgggtggacgtggtgctggaacatggcggctgcgtgacagtgatggcccaggacaagcccaccgtggacatcgagctcgtgaccaccaccgtgtccaatatggccgaagtgcggagctactgctacgaggccagcatcagcgacatggccagcgacagcagatgccctacacagggcgaggcctacctggacaagcagtccgacacccagtacgtgtgcaagcggaccctggtggacaggggctggggcaatggctgtggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaaacactggctggtgcacaaagagtggttccacgacatccccctgccctggcatgctggcgctgatacaggcaccccccactggaacaacaaagaggccctggtggaattcaaggacgcccacgccaagcggcagaccgtggtggtgctgggatctcaggaaggcgccgtgcatacagctctggctggcgccctggaagccgaaatggatggcgccaaaggcagactgagcagcggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcaggctgatcacagccaaccctgtgatcaccgagagcaccgagaacagcaagatgatgctggaactggacccccccttcggcgactcctacatcgtgatcggcgtgggagagaagaagatcacccaccactggcacagaagcggcagcaccatcggcaaggcctttgaggctacagtgcggggagccaagagaatggccgtgctgggcgataccgcctgggattttggctctgtgggcggagccctgaacagcctgggaaagggcatccaccagatcttcggagccgcctttaagagcctgttcggcggcatgagctggttcagccagatcctgatcggcaccctgctgatgtggctgggcctgaacaccaagaacggcagcatctccctgatgtgcctggctctgggcggcgtgctgatctttctgagcacagccgtgtccgcc

SEQ ID NO: 65 - DNA, 2064 bp, Artificial Sequence
  Synthetic Polynucleotide
atgaagtgcctgctgtacctggccttcctgttcatcggcgtgaactgcgccgaagtgaccagaagaggcagcgcctactacatgtacctggaccggaacgatgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggccgctgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggacaagcccaccgtggacatcgagctcgtgaccaccaccgtgtccaatatggccgaagtgcggagctactgctacgaggccagcatcagcgacatggccagcgacagcagatgccctacacagggcgaggcctacctggacaagcagtccgacacccagtacgtgtgcaagcggaccctggtggatagaggctggggcaatggctgcggcctgtttggcaagggcagcctcgtgacctgtgccaagttcgcctgcagcaagaagatgaccggcaagagcatccagcccgagaacctggaataccggatcatgctgagcgtgcacggcagccagcactccggcatgatcgtgaacgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgccggcgctgatacaggcacaccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtccagcggccacctgaagtgcagactgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgccagctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagaagcggcagcaccatcggcaaggcctttgaggctacagtgcggggagccaagagaatggccgtgctgggagataccgcctgggactttggctctgtgggcggagccctgaactctctgggcaagggaatccaccagatcttcggagccgcctttaagagcctgttcggcggcatgagctggttcagccagatcctgatcggcaccctgctgatgtggctgggcctgaacaccaagaacggcagcatctccctgatgtgcctggctctgggaggcgtgctgatcttcctgagcacagccgtgtctgcc

SEQ ID NO: 66 - DNA, 2070 bp, Zika virus
atggactggacctggatcctgttcctggtggccgctgccacaagagtgcacagcgtggaagtgaccagacggggcagcgcctactacatgtacctggacagaagcgacgccggcgaggccatcagctttccaaccaccctgggcatgaacaagtgctacatccagatcatggacctgggccacatgtgcgacgccaccatgagctacgagtgccccatgctggacgagggcgtggaacccgacgatgtggactgctggtgcaacaccaccagcacctgggtggtgtacggcacctgtcaccacaagaagggcgaagccagacggtccagacgggccgtgacactgcctagccacagcaccagaaagctgcagacccggtcccagacctggctggaaagcagagagtacaccaagcacctgatccgggtggaaaactggatcttccggaaccccggctttgccctggctgccgctgctattgcttggctgctgggcagcagcacctcccagaaagtgatctacctcgtgatgatcctgctgatcgcccctgcctacagcatccggtgtatcggcgtgtccaaccgggacttcgtggaaggcatgagcggcggcacatgggtggacgtggtgctggaacatggcggctgcgtgacagtgatggcccaggataagcccgccgtggacatcgagctcgtgaccaccaccgtgtccaatatggccgaagtgcggagctactgctacgaggccagcatcagcgacatggccagcgacagcagatgccctacacagggcgaggcctacctggataagcagtccgacacccagtacgtgtgcaagcggaccctggtggatagaggctggggcaatggctgcggcctgtttggcaagggcagcctcgtgacctgcgccaagttcgcctgcagcaagaagatgaccggcaagagcatccagcccgagaacctggaataccggatcatgctgagcgtgcacggctcccagcacagcggcatgatcgtggccgacaccggccacgagacagacgagaaccgggccaaggtggaaatcacccccaacagccctagagccgaggccacactgggcggctttggatctctgggcctggactgcgagcctagaaccggcctggatttcagcgacctgtactacctgaccatgaacaacaagcactggctggtgcacaaagagtggttccacgacatccccctgccctggcatgctggcgctgatacaggcaccccccactggaacaacaaagaggctctggtggaattcaaggacgcccacgccaagcggcagaccgtggtggtgctgggatctcaggaaggcgccgtgcatacagctctggctggcgccctggaagccgaaatggatggcgccaaaggcagactgtcctccggccacctgaagtgccggctgaagatggacaagctgcggctgaagggcgtgtcctacagcctgtgtaccgccgccttcaccttcaccaagatccccgccgagacactgcacggcaccgtgactgtggaagtgcagtacgccggcaccgacggcccttgtaaagtgcctgctcagatggccgtggatatgcagaccctgacccccgtgggcagactgatcaccgccaaccctgtgatcaccgagagcaccgagaacagcaagatgatgctggaactggacccccccttcggcgactcctacatcgtgatcggcgtgggagagaagaagatcacccaccactggcacagatccggcagcaccatcggcaaggcctttgaggctacagtgcggggagccaagagaatggccgtgctgggcgataccgcctgggattttggctctgtgggcggagccctgaacagcctgggaaagggcatccaccagatcttcggcgctgccttcaagagcctgttcggcggcatgagctggttcagccagatcctgatcggcaccctgctcgtgtggctgggcctgaacaccaagaacggcagcatctccctgacctgcctggctctgggcggcgtgctgatctttctgagcacagccgtgtccgcc

SEQ ID NO: 67 - protein, 794 aa, Zika virus
MKNPKEEIRRIRIVNMLKRGVARVSPFGGLKRLPAGLLLGHGPIRMVLAILAFLRFTAIKPSLGLINRWGSVGKKEAMEIIKKFKKDLAAMLRIINARKEKKRRGTDTSVGIVGLLLTTAMAVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 68 - protein, 788 aa, Zika virus
MKNPKKKSGGFRIVNMLKRGVARVNPLGGLKRLPAGLLLGHGPIRMVLAILAFLRFTAIKPSLGLINRWGTVGKKEAMEIIKKFKKDLAAMLRIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFTLVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 69 - protein, 794 aa, Zika virus
MKNPKRAGSSRLVNMLRRGAARVIPPGGGLKRLPVGLLLGRGPIKMILAILAFLRFTAIKPSTGLINRWGKVGKKEAIKILTKFKADVGTMLRIINNRKTKKRGVETGIVFLALLVSIVAVEVTKKGDTYYMFADKKDAGKVVTFETESGPNRCSIQAMDIGHMCPATMSYECPVLEPQYEPEDVDCWCNSTAAWIVYGTCTHKTTGETRRSRRSITLPSHASQKLETRSSTWLESREYSKYLIKVENWILRNPGYALVAAVIGWTLGSSRSQKIIFVTLLMLVAPAYSIRCIGIGNRDFIEGMSGGTWVDIVLEHGGCVTVMSNDKPTLDFELVTTTASNMAEVRSYCYEANISEMASDSRCPTQGEAYLDKMADSQFVCKRGYVDRGWGNGCGLFGKGSIVTCAKFTCVKKLTGKSIQPENLEYRVLVSVHASQHGGMINNDTNHQHDKENRARIDITASAPRVEVELGSFGSFSMECEPRSGLNFGDLYYLTMNNKHWLVNRDWFHDLSLPWHTGATSNNHHWNNKEALVEFREAHAKKQTAVVLGSQEGAVHAALAGALEAESDGHKATIYSGHLKCRLKLDKLRLKGMSYALCTGAFTFARTPSETIHGTATVELQYAGEDGPCKVPIVITSDTNSMASTGRLITANPVVTESGANSKMMVEIDPPFGDSYIIVGTGTTKITHHWHRAGSSIGRAFEATMRGAKRMAVLGDTAWDFGSVGGMFNSVGKFVHQVFGSAFKALFGGMSWFTQLLIGFLLIWMGLNARGGTVAMSFMGIGAMLIFLATSVSG

SEQ ID NO: 70 - protein, 790 aa, Zika virus
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 71 - protein, 789 aa, Zika virus
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 72 - protein, 794 aa, Zika virus
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 73 - protein, 788 aa, Zika virus
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 74 - protein, 794 aa, Zika virus; identical to SEQ ID NO: 72

SEQ ID NO: 75 - protein, 794 aa, Zika virus
  misc_feature (446)..(452): Xaa can be any naturally occurring amino acid
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLIMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDXXXXXXXNRAEVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 76 - protein, 794 aa, Zika virus
MKNPKKRSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCQHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 77 - protein, 794 aa, Zika virus
MKNPKKKSGRFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGETRRSRRSVSLRYHYTRKLQTRSQTWLESREYKKHLIMVENWIFRNPGFAIVSVAITWLMGSLTSQKVIYLVMIVLIVPAYSISCIGVSNRDLVEGMSGGTWVDVVLEHGGCVTEMAQDKPTVDIELVTMTVSNMAEVRSYCYEASLSDMASASRCPTQGEPSLDKQSDTQSVCKRTLGDRGWGNGCGIFGKGSLVTCSKFTCCKKMPGKSIQPENLEYRIMLPVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQSAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 78 - protein, 794 aa, Zika virus
  misc_feature (442)..(446): Xaa can be any naturally occurring amino acid
MKNPKRKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMXXXXXGHETDENRAKVEVTPNSPRAEATLGGFGSLGLDCEPRTGLDFSDLYYLTMNNKHRLVRKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWLKKGSSIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 79 - protein, 794 aa, Zika virus
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 80 - protein, 794 aa, Zika virus
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 81 - protein, 794 aa, Zika virus
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMTVNDIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 82 - protein, 674 aa, Zika virus
VEVTKKGDTYYMFADKKDAGKVVTFETESGPNRCSIQAMDIGHMCPATMSYECPVLEPQYEPEDVDCWCNSTAAWIVYGTCTHKTTGETRRSRRSITLPSHASQKLETRSSTWLESREYSKYLIKVENWILRNPGYALVAAVIGWTLGSSRSQKIIFVTLLMLVAPAYSIRCIGIGNRDFIEGMSGGTWVDIVLEHGGCVTVMSNDKPTLDFELVTTTASNMAEVRSYCYEANISEMASDSRCPTQGEAYLDKMADSQFVCKRGYVDRGWGNGCGLFGKGSIVTCAKFTCVKKLTGKSIQPENLEYRVLVSVHASQHGGMINNDTNHQHDKENRARIDITASAPRVEVELGSFGSFSMECEPRSGLNFGDLYYLTMNNKHWLVNRDWFHDLSLPWHTGATSNNHHWNNKEALVEFREAHAKKQTAVVLGSQEGAVHAALAGALEAESDGHKATIYSGHLKCRLKLDKLRLKGMSYALCTGAFTFARTPSETIHGTATVELQYAGEDGPCKVPIVITSDTNSMASTGRLITANPVVTESGANSKMMVEIDPPFGDSYIIVGTGTTKITHHWHRAGSSIGRAFEATMRGAKRMAVLGDTAWDFGSVGGMFNSVGKFVHQVFGSAFKALFGGMSWFTQLLIGFLLIWMGLNARGGTVAMSFMGIGAMLIFLATSVSG

SEQ ID NO: 83 - protein, 668 aa, Zika virus
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 84 - protein, 672 aa, Zika virus
AEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 85 - protein, 672 aa, Zika virus
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 86 - protein, 672 aa, Zika virus
AEITRRGSAYYMYLDRSDAGKAISFATTLGVNKCHVQIMDLGHMCDATMSYECPMLDEGVEPDDVDCWCNTTSTWVVYGTCHHKKGETRRSRRSVSLRYHYTRKLQTRSQTWLESREYKKHLIMVENWIFRNPGFAIVSVAITWLMGSLTSQKVIYLVMIVLIVPAYSISCIGVSNRDLVEGMSGGTWVDVVLEHGGCVTEMAQDKPTVDIELVTMTVSNMAEVRSYCYEASLSDMASASRCPTQGEPSLDKQSDTQSVCKRTLGDRGWGNGCGIFGKGSLVTCSKFTCCKKMPGKSIQPENLEYRIMLPVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQSAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 87 - protein, 673 aa, Zika virus
  misc_feature (321)..(325): Xaa can be any naturally occurring amino acid
AAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMXXXXXGHETDENRAKVEVTPNSPRAEATLGGFGSLGLDCEPRTGLDFSDLYYLTMNNKHRLVRKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWLKKGSSIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 88 - protein, 672 aa, Zika virus
AEITRRGSAYYMYLDRSDAGKAISFATTLGVNKCHVQIMDLGHMCDATMSYECPMLDEGVEPDDVDCWCNTTSTWVVYGTCQHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 89 - protein, 672 aa, Zika virus
  misc_feature (324)..(330): Xaa can be any naturally occurring amino acid
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLIMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDXXXXXXXNRAEVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 90 - protein, 672 aa, Zika virus
AEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 91 - protein, 666 aa, Zika virus
AEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 92 - protein, 672 aa, Zika virus; identical to SEQ ID NO: 90

SEQ ID NO: 93 - protein, 672 aa, Zika virus
VEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 94 - protein, 666 aa, Zika virus
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFTLVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 95 - protein, 668 aa, Zika virus; identical to SEQ ID NO: 83

SEQ ID NO: 96 - protein, 672 aa, Zika virus
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMTVNDIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 97 - protein, 672 aa, Zika virus; identical to SEQ ID NO: 84

SEQ ID NO: 98 - protein, 672 aa, Zika virus; identical to SEQ ID NO: 84

SEQ ID NO: 99 - protein, 672 aa, Zika virus; identical to SEQ ID NO: 84

SEQ ID NO: 100 - protein, 672 aa, Zika virus; identical to SEQ ID NO: 84

SEQ ID NO: 101 - protein, 672 aa, Zika virus
AEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 102 - protein, 672 aa, Zika virus
AEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 103 - protein, 168 aa, Zika virus
AEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYS

SEQ ID NO: 104 - protein, 504 aa, Zika virus
IRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 105 - protein, 125 aa, Zika virus
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEV

SEQ ID NO: 106 - protein, 362 aa, Zika virus
VGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSL

SEQ ID NO: 107 - protein, 218 aa, Zika virus
GVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWP

SEQ ID NO: 108 - protein, 144 aa, Zika virus
PSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGE

SEQ ID NO: 109 - protein, 603 aa, Zika virus
TTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDYSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAA

SEQ ID NO: 110 - protein, 147 aa, Zika virus
FGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITA

SEQ ID NO: 111 - protein, 502 aa, Zika virus
NELGWLERTKSDLSHLMGRREEGATMGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLMAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPV

SEQ ID NO: 112 - protein, 652 aa, Zika virus
KYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 113 - protein, 692 aa, Zika virus
METPAQLLFLLLLWLPDTTGAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 114 - protein, 524 aa, Zika virus
METPAQLLFLLLLWLPDTTGIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 115 - protein, 690 aa, Zika virus
MDWTWILFLVAAATRVHSVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 116 - protein, 690 aa, Zika virus; identical to SEQ ID NO: 115

SEQ ID NO: 117 - protein, 687 aa, Zika virus
MDWTWILFLVAAATRVHSTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 118 - protein, 692 aa, Zika virus
METPAQLLFLLLLWLPDTTGVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 119 - protein, 689 aa, Zika virus
METPAQLLFLLLLWLPDTTGTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 120 - protein, 524 aa, Zika virus
METPAQLLFLLLLWLPDTTGIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 121 - protein, 687 aa, Zika virus; identical to SEQ ID NO: 117

SEQ ID NO: 122 - protein, 692 aa, Zika virus; identical to SEQ ID NO: 118

SEQ ID NO: 123 - protein, 689 aa, Zika virus; identical to SEQ ID NO: 119

SEQ ID NO: 124 - protein, 524 aa, Zika virus; identical to SEQ ID NO: 120

SEQ ID NO: 125 - protein, 20 aa, Artificial Sequence
  Synthetic Polypeptide
METPAQLLFLLLLWLPDTTG

SEQ ID NO: 126 - protein, 18 aa, Artificial Sequence
  Synthetic Polypeptide
MDWTWILFLVAAATRVHS

SEQ ID NO: 127 - protein, 672 aa, Zika virus; identical to SEQ ID NO: 84

SEQ ID NO: 128 - protein, 24 aa, Artificial Sequence
  Synthetic Polypeptide
MLGSNSGQRVVFTILLLLVAPAYS

SEQ ID NO: 129 - protein, 696 aa, Zika virus
MLGSNSGQRVVFTILLLLVAPAYSAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 130 - protein, 671 aa, Zika virus
EVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 131 - protein, 17 aa, Artificial Sequence
  Synthetic Polypeptide
MKCLLYLAFLFIGVNCA

SEQ ID NO: 132 - protein, 688 aa, Artificial Sequence
  Synthetic Polypeptide
MKCLLYLAFLFIGVNCAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 133 - protein, 672 aa, Artificial Sequence
  Synthetic Polypeptide
VEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVADTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 134 - protein, 690 aa, Artificial Sequence
  Synthetic Polypeptide
MDWTWILFLVAAATRVHSVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVADTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 135 - DNA, 92 bp, Dengue virus
tcaagcttttggaccctcgtacagaagctaatacgactcactatagggaaataagagagaaaagaagagtaagaagaaatataagagccacc

SEQ ID NO: 136 - DNA, 92 bp, Dengue virus; identical to SEQ ID NO: 135

SEQ ID NO: 137 - DNA, 92 bp, Dengue virus; identical to SEQ ID NO: 135

SEQ ID NO: 138 - DNA, 92 bp, Dengue virus; identical to SEQ ID NO: 135

SEQ ID NO: 139 - DNA, 92 bp, Dengue virus; identical to SEQ ID NO: 135

SEQ ID NO: 140 - DNA, 92 bp, Dengue virus; identical to SEQ ID NO: 135

SEQ ID NO: 141 - DNA, 92 bp, Dengue virus; identical to SEQ ID NO: 135

SEQ ID NO: 142 - DNA, 92 bp, Dengue virus; identical to SEQ ID NO: 135

SEQ ID NO: 143 - DNA, 92 bp, Dengue virus; identical to SEQ ID NO: 135

SEQ ID NO: 144 - DNA, 2058 bp, Dengue virus
atgctgaatattctgaaccgccgccgccggactgccgggattataattatgatgattcccaccgtgatggccttccacctgaccacccggaacggggaaccacatatgatcgtgtccagacaggagaagggaaagtccctgctgttcaagaccgaggacggcgtgaacatgtgcaccctcatggctatggacctgggcgaactctgcgaggacaccatcacctacaagtgccccctgttgaggcagaacgagccggaggatattgactgctggtgcaattcgaccagcacctgggtcacctacgggacttgcaccacaaccggagaacatcggcgcgaaaagcgcagcgtggctttggtgcctcacgtcggaatggggctggagactagaaccgagacttggatgtcgtcggaaggggcctggaaacacgcacagcgcatcgaaacttggatactcaggcatcccggcttcaccattatggccgcgatcctggcatacaccatcggtactacccacttccaacgggccctgatctttatcctcctgaccgctgtcgcaccatccatgaccatgcggtgtatcggtatcagcaacagggacttcgtggagggagtgtcgggaggatcctgggtggatattgtgctggaacacggttcctgcgtcactaccatggcgaagaacaagcctaccctggactttgagctgatcaaaactgaggccaagcagccggccaccctgcgcaagtactgcatcgaagccaagctgaccaataccactaccgaatcccgctgtccgacccaaggggagccctccctgaatgaggagcaggacaagcgcttcgtctgcaagcattcaatggtcgaccgcggctggggaaacggctgcggactgttcggaaagggcggcattgtgacctgtgccatgttcacttgcaagaagaacatggaaggaaagatcgtgcagcccgaaaacctggagtataccatcgtcgtgaccccgcactccggggaagaacacgctgtgggaaacgacaccggaaagcacggaaaggagatcaaagtgaccccacagtcgagcattaccgaggccgaacttactggttacggcactgtgacgatggaatgttcaccgagaactggactggatttcaacgaaatggtgctgctccaaatggaaaacaaggcctggctggtgcaccgccagtggtttcttgacctccctctcccttggctgcctggagcagacactcagggttccaactggattcagaaggaaacactcgtgaccttcaagaaccctcacgcgaagaagcaggatgtggtcgtgctgggaagccaggagggagcgatgcataccgccctcaccggcgcgacggagattcagatgtccagcggaaaccttctgttcaccggacacctgaagtgcagactgaggatggacaagctgcagctcaagggaatgtcctactccatgtgcactggaaagttcaaggtcgtgaaggagattgccgaaactcagcatggtaccatcgtgatccgggtgcaatatgaaggggacggatccccgtgcaagatccctttcgaaatcatggacttggagaagcgacacgtgctgggcagactgatcacagtcaaccccatcgtgactgagaaggattcacccgtgaacattgaagccgagccgcctttcggcgatagctacatcatcattggcgtggaaccgggacagcttaagctcaactggttcaagaagggttcctcgatcggtcaaatgtttgaaaccacgatgcggggtgccaaacggatggccattctgggagacaccgcctgggatttcggctccttgggcggagtgttcacttctatcggaaaggcgctgcaccaagtgttcggagccatctacggcgccgcgttctcgggcgtcagctggaccatgaagattctgatcggggtcatcatcacttggattgggatgaactcacggtccacctccctgagcgtgtcccttgtcctggtcggcatcgtgaccctgtacctcggagtgatggtgcaggcttag

SEQ ID NO: 145 - DNA, 2058 bp, Dengue virus
atgcttaacattctcaaccgccgccggagaactgctggtattatcattatgatgattcccactgtgatggccttccacctgaccacgcggaacggcgaaccccatatgattgtcggtcggcaggaaaaggggaagtccctgctgttcaaaactgaggacggagtgaacatgtgcaccctcatggctattgacctgggagagctgtgcgaagatactatcacgtacaagtgccccctgctgcgccagaacgagcctgaggacattgactgctggtgcaactccacgtcaacctgggtcacctacggaacttgcgcgactaccggcgaacatcgcagagaaaagagaagcgtggccctcgtgccgcacgtcgggatggggctggaaacccggaccgaaacctggatgtcctcggaaggcgcctggaagcacgtgcagaggatcgaaacttggatcctccggcacccgggattcaccatcatggccgccatcctcgcttacacaatcggaaccactcactttcaacgcgccctgatcttcatcctgcttaccgccgtggccccgtccatgaccatgcgctgcattggaatgtcaaaccgggacttcgtcgagggagtctccggaggaagctgggtggacatcgtgctggagcacggcagctgtgtgaccaccatggccaagaacaagccaactcttgatttcgaactgatcaagaccgaggccaagcagcctgccactctgaggaagtactgtatcgaagcgaagctgaccaacaccactaccgaatcccgctgcccgacccagggcgaaccttccttgaacgaagaacaggacaagagattcgtgtgcaagcatagcatggtcgacaggggatgggggaacggatgtggactctttgggaagggcggaatcgtcacctgtgcgatgttccggtgcaagaagaacatggaggggaaggtcgtgcagcccgaaaatctcgagtacactatcgtgatcaccccgcattccggagaggagcacgccgtgggcaacgacaccgggaagcacggaaaggagatcaaaattacccctcaatcctccaccaccgaagccgaattgactggttacggtaccgtgactatggagtgctcgccgcggactggcttggacttcaacgagatggtgctgctgcaaatggagaacaaggcctggctggtgcaccggcagtggtttcttgatctgcctctgccttggctgcccggagccgacacccagggtagcaattggatccagaaagagacactcgtgacctttaagaacccgcacgcaaagaagcaggatgtcgtggtcctgggaagccaagaaggggcaatgcataccgcactcactggagccactgaaatccagatgtcctccggcaatctgctgttcaccggccatctgaagtgccgactgcgcatggacaagctccagcttaagggaatgtcctactccatgtgtactggaaagttcaaagtcgtgaaggaaattgccgaaacccagcacggcaccatagtgatccgggtgcagtacgagggcgacggctcaccctgcaaaatcccgttcgagattatggatctcgaaaagcgccacgtgctgggcagactgattaccgtgaaccctatcgtgaccgagaaggattccccagtgaacatcgaggccgaaccgcccttcggagactcgtatatcatcatcggcgtggagcccggccagctgaagctgaactggttcaagaaggggtcgagcatcggccagatgttcgagactaccatgcgcggcgcgaagaggatggcgatcctgggggataccgcttgggacttcggttccctcggcggggtgttcacctcgattgggaaggccctccaccaagtgttcggtgcaatctacggagcggcgttcagcggagtgtcgtggaccatgaagattctgatcggcgtgatcatcacctggattggcatgaactcccggtctactagcctgtcggtgaccctggtgctggtcggaatcgtgaccttgtacctgggagtgatggtgcaagcttag

SEQ ID NO: 146 - DNA, 2058 bp, Dengue virus
atgctgaacatcctgaaccgcagaaggagaaccgccggtattattattatgatgatccccaccgtgatggcattccacctgactacccgcaacggagagccgcatatgatcgtgggccgccaggaaaagggaaagtccctgctgttcaagactgaggacggcgtgaacatgtgcactctcatggccatcgacctcggcgaactgtgcgaggacaccattacttacaagtgcccgctgctgagacagaacgagcctgaggacatcgactgttggtgtaactcgacctccacctgggtcacctacggaacgtgcgccacaaccggagaacaccgccgggaaaagcggagcgtggctctggtgccgcacgtcggaatgggtctggagactagaaccgaaacctggatgtcatccgagggggcatggaaacatgtgcagcgaatcgagacttggatcctgagacacccgggcttcactatcatggcggccatccttgcctacaccattggcactactcacttccaacgggcgctgatcttcatactgctcaccgcggtggccccctccatgacgatgcgctgcatcggaatctccaaccgggacttcgtggagggcgtcagcggaggcagctgggtggacatcgtgttggagcacggaagctgcgtgaccaccatggccaagaacaagcccactcttgattttgagctgatcaagacggaagcaaagcagccggccactctgaggaagtactgcatcgaggccaagctcaccaacacaaccaccgaatctcggtgcccgacccaaggagagccatcactgaacgaggaacaggacaagagattcctgtgcaaacattcgatggtggacaggggatggggaaatggttgcggcctgttcggcaaaggaggcattgtgacctgtgcgatgttcacttgcaagaaaaacatggaggggaaggtcgtgttgccggagaacctggagtacactatcgtgattaccccgcactccggggaggaacatgccgtgggaaatgacaccggaaagcacgggaaggaaatcaaaatcacgcctcagtcctcaatcaccgaagccgagcttaccggctacggtaccgtgaccatggagtgcagccctcggactggactggacttcaacgagatggtgctgctgcaaatggaagataaggcctggctggtgcaccggcagtggttcttggatttgccactgccttggctgcccggcgcggatacccagggttccaactggattcagaaggaaaccctcgtgaccttcaagaatcctcacgccaagaagcaggacgtggtggtgctgggttcccaagaaggggccatgcatactgccctcactggagcgaccgaaatccagatgtcgtccggcaacctcctgttcaccggccacctgaagtgccgcctgcggatggacaagttgcagctgaagggaatgagctactcgatgtgtaccggaaagttcaagatcgtgaaggaaatcgccgaaacccagcacggaaccatcgtcattagagtgcagtacgaaggggacggcagcccgtgcaagatccccttcgaaattatggacctggagaagcgccacgtgctcggaaggctcatcactgtcaacccaatcgtcaccgaaaaggactcccctgtgaacatcgaagcagagccccctttcggggactcctacattattatcggcgtggagcccggccagctgaagctgaactggttcaagaagggatcctcgatcggacagatgttcgaaaccaccatgcggggagccaagcggatggctattctgggagataccgcttgggatttcggctccctcggcggcgtctttacttccatcgggaaagcgctccaccaagtgtttggagccatctacggtgccgctttttccggggtgtcatggaccatgaagattcttatcggggtcattattacttggatcggcatgaactcccggagcacctcgctgtccgtgagcctcgtgctcgtgggggtggtcactctgtatcttggtgccatggtgcaggcctag

SEQ ID NO: 147 - DNA, 2058 bp, Dengue virus
atgcttaacatcctgaatagaagaagaagaaccgccggcattatcattatgatgatacccaccgtgatggccttccacctgactactcgcaacggagagcctcatatgatcgtgtcgcggcaggagaagggaaagtccctgctgtttaagacggaggacggcgtgaacatgtgcactcttatggcaatggaccttggagagctgtgcgaggataccatcacctacaagtgtccgttcctgaagcaaaacgagcctgaggatattgactgctggtgcaactccacctcaacctgggtcacatatgggacctgtaccactactggcgaacaccgccgcgagaaaagaagcgtggcgttggtgcctcacgtcggcatgggtctggaaactcggaccgaaacttggatgagctcagagggggcatggaagcacgcccagaggattgaaacctggattctgcgccaccctggattcaccatcatggcggctattctggcgtacactattggaaccacccactttcagcgggcccttatcttcatcctcctcactgccgtggcgccctccatgactatgcggtgtatcggaatttccaaccgcgacttcgtggaaggagtgtccggaggctcctgggtcgacattgtgctggaacatggttcatgcgtgaccacgatggccaagaacaagcccaccctcgacttcgagctgatcgagactgaagccaagcagccggccactctgcggaagtactgtatcgaggccaagctcaccaacaccaccaccgattcccgctgcccgacccaaggagaaccttcgctcaacgaggagcaggacaagcggttcgtgtgcaagcacagcatggtcgacaggggatgggggaatggatgcggtctgttcggaaagggaggcattgtgacttgtgcaatgttcacttgcaagaagaacatgaaggggaaggtcgtgcagccggaaaacctggagtacaccatcgtgatcacccctcattcgggcgaagaacacgctgtggggaatgataccggaaagcacggaaaggaaattaagatcacaccccaatccagcatcactgaggcagaactgaccggctacggcactgtgaccatggagtgctcgcctcggactggcctggacttcaacgagatggtgctgctccaaatggaaaacaaggcctggctggtgcacagacagtggttcctcgatttgcccttgccgtggctccctggcgccgacacccagggatctaactggatccagaaggaaacccttgtgaccttcaagaacccgcacgctaagaaacaggatgtggtggtgctgggaagccaggaaggagcaatgcataccgcgctcacgggtgccaccgagatccagatgagctccgggaacctcctgttcaccggtcacctgaagtgccgactccgcatggacaaactgcagctcaaggggatgtcctactccatgtgcaccgggaaattcaaggtcgtgaaggagatcgctgagactcagcacggtactatcgtgatccgggtgcagtatgagggagatgggagcccgtgcaaaatcccatttgagatcatggacttggaaaagcgccatgtgctgggtcggctgattaccgtgaacccaatcgtcaccgaaaaggacagccccgtcaacattgaagccgaaccacccttcggagactcgtacatcatcattggcgtggaaccgggccagctgaagctgaactggttcaaaaaggggtcctctatcggccaaatgatcgaaaccaccatgcggggagctaagcggatggcgattttgggagacactgcgtgggactttggctcactggggggagtgttcaccagcatcggcaaagccctgcaccaagtgttcggtgccatctacggagccgccttcagcggagtgtcctggatcatgaagatcctgatcggcgtgatcattacctggatcggcatgaactccaggtccacctcgctctccgtgtcgctggtgctggtcggggtcgtgaccctgtacctgggagtgatggtccaggcctga

SEQ ID NO: 148 - DNA, 2058 bp, Dengue virus
atgttgaatatcctgaaccgccgccggagaactgccggaattatcattatgatgatccctaccgtgatggcgttccaccttactacccggaacggggagcctcacatgatcgtgtcacgccaggagaaggggaaatccctgctgttcaagaccaaggacggtaccaacatgtgtaccctgatggcgatggacctcggagagctgtgcgaggacaccatcacctacaaatgcccgttcctgaagcagaacgagccggaagatattgactgttggtgcaactccacctccacttgggtcacctacggaacttgcaccactactggggagcatagacgggagaagcgctccgtggccctggtgccgcacgtcggcatgggactggaaaccagaaccgagacttggatgtccagcgaaggcgcctggaagcacgcccagcggattgaaacttggatcctgaggcacccgggttttaccattatggccgctatcttggcatacaccatcggcaccacccacttccaacgcgtcctgatcttcatcctgctgaccgccattgcgccctccatgaccatgcggtgcatcggaatcagcaaccgcgacttcgtggaaggcgtcagcggcggttcttgggtggacatcgtgttggagcacggatcgtgcgtgaccaccatggccaagaacaagccgaccctcgatttcgagctgatcaagactgaagccaagcagccagctaccctgcggaagtattgcatcgaagccaagctcactaatactacgaccgacagccggtgtccgacccaaggagagcccaccctgaatgaggaacaagacaagcgcttcgtgtgcaagcattccatggtggaccggggctggggaaacggctgcggactgttcgggaaaggaggaattgtgacttgcgccatgttcacttgcaagaagaacatggaggggaagatcgtccagcctgagaacctcgagtacacggtcgtgattactccgcactcgggagaagaacacgccgtgggcaacgacaccggaaagcatgggaaggaagtgaaaatcacgccccaatcgtcgattaccgaggctgagctgaccggctacggcaccgtgaccatggagtgctccccgaggaccggactggacttcaacgaaatggtgctgctgcagatgaaggacaaggcctggctggtgcaccgccagtggttcctcgacctcccactcccctggctgcccggagcggatacgcagggatccaactggatccagaaggaaactcttgtgaccttcaagaaccctcatgccaagaagcaggacgtggtggtcctgggatcccaagagggcgcgatgcacaccgcactgaccggcgccaccgaaattcagatgtcctccggaaacctcctgttcactggccacctgaagtgcagactccgcatggacaagctgcagctcaaggggatgagctactccatgtgtaccggaaaattcaaggtcgtgaaggaaattgcagaaacacagcatgggacaattgtcattcgggtccagtacgagggcgatggttcaccgtgcaagactccattcgagatcatggatctggagaaaagacacgtgctgggtcggctgactaccgtgaacccaatcgtgactgagaaggactcccccgtgaacatcgaagccgagcctccttttggcgattcctacatcatcattggagtggaacccggacagcttaagttggattggttcaagaagggctcctcgatcggacagatgttcgaaaccaccatgcgcggtgccaagcgaatggccatcctgggggacaccgcctgggacttcggtagcctgggcggagtgtttacctcaattggaaaggctctgcaccaagtgtttggggcgatctacggagcggccttcagcggtgtctcctggactatgaagattctcatcggagtgataatcacctggatcggcatgaacagccggtcaaccagcctgtccgtgtccctggtgctggtcggcatcgtgactctctacctcggagtgatggtgcaggcctag

SEQ ID NO: 149 - DNA, 2058 bp, Dengue virus
atgctcaacatactgaacagacggagaaggaccgccggtattattatcatgatgatccctactgtgatggcattccacctgacaacccgcaacggagagccccacatgatcgtgtcacgccaggagaaagggaagtcactgctgttcaagaccgaagtcggcgtgaacatgtgtaccctgatggcgatggatcttggcgaactgtgcgaggacaccatcacgtacaagtgccccctgttgcggcaaaacgaaccagaggacatcgactgctggtgtaactccacctcgacctgggtcacctacggaacctgtaccactatgggggaacaccggcgggagaagcgctccgtggcgctcgtgcctcatgtcggcatgggactggagactcggactgaaacctggatgtcgtcggagggggcctggaagcacgtccagcggatcgagacttggatccttcgccatccgggcttcaccatgatggccgccatcctggcctacaccatcggaaccacccatttccaacgggccctgatcctgatcctgttgactgccgtgaccccctccatgactatgcggtgcattgggatgtcgaacagggatttcgtggagggagtcagcggtggcagctgggtggacatcgtgctggaacatggatcctgcgtgactaccatggcaaagaacaagccaaccctcgatttcgaactgatcaagaccgaggcgaaacagccggcgaccctgaggaagtactgcatcgaggccaagctcaccaacaccactaccgagagcagatgccctacccaaggggaaccttccctgaacgaggagcaggacaagagattcgtctgcaagcactccatggtggaccgcggctggggaaacggatgcggactcttcggaaagggcggtattgtgacctgtgccatgttccgctgcaagaaaaacatggaagggaaagtggtgcagcccgagaacctcgagtacactatcgtgatcacaccgcacagcggagaagaacacgccgtgggcaacgacactggaaagcacgggaaggaaatcaagatcaccccgcaatcctcaatcactgaggctgagttgaccggctacgggactattaccatggaatgctccccacgaacgggactggacttcaacgaaattgtgttgctccaaatggaaaacaaggcctggctcgtgcaccggcagtggttcctggatctgcccctgccgtggctgccgggtgccgacactcaggggagcaactggattcagaaggaaacccttgtgaccttcaagaacccccacgcaaagaagcaggacgtggtggtgctgggtagccaagaaggcgccatgcacacggccctgaccggagcgaccgagatccagatgtccagcggaaatctgctctttactggtcatctgaagtgcagacttcggatggacaagctgcaactgaagggaatgtcctactcaatgtgcactggaaagttcaaggtcgtgaaggagatcgccgaaacccagcacgggactatcgtcatccgcgtgcagtacgaaggagatggctccccgtgcaagatccctttcgaaatcatggacctggagaagcgccacgtgttggggcgccttattactgtgaaccccatcgtgaccgagaaggactcccctgtcaacatcgaggctgaaccgccattcggagattcctatatcattatcggagtggaaccgggccagctcaagctgaattggttcaagaagggatcctcgattggccagatgttcgaaacgactatgcggggcgctaagcgcatggccatcctgggcgatactgcctgggattttggttctctgggcggagtgttcacctccattggaaaggccctgcaccaagtgttcggcgccatctacggtgccgcgtttagcggtgtctcatggaccatgaaaatcctcattggcgtgatcattacctggattggcatgaactccagaagcacttccctgtccgtgaccctggtgctcgtcggaattgtgacactctacctcggagtgatggtgcaggcttga

SEQ ID NO: 150 - DNA, 2058 bp, Dengue virus
atgctgaacattttgaacagacgccgaaggaccgcaggcattatcattatgatgatccctaccgtgatggccttccatctgactactaggaacggagagccacatatgatcgtgtcgcgccaggaaaagggaaagagcctgctttttaaaaccaaggacggcacgaacatgtgcacccttatggccatggacctgggggagttgtgcgaggacaccatcacctacaagtgcccgttcctgaagcaaaacgagcccgaagatattgactgctggtgcaactccacctccacctgggtcacttatgggacttgcaccaccaccggcgaacatcgcagagaaaagagaagcgtggccctggtcccccacgtcgggatgggcctcgagactcggaccgaaacttggatgtcatcagagggcgcatggaagcatgctcagcggatcgaaacctggatcctgagacaccctggtttcacaattatggccgccattcttgcgtacacgatcggaacgactcatttccaacgcgtgctgatcttcattctcctgaccgctattgcgccgtccatgactatgcggtgcatcggaatctcaaaccgggacttcgtggaaggagtgtcgggaggatcctgggtggacattgtgctggagcacggttcctgcgtcaccaccatggccaaaaacaagcctaccctggacttcgagctgatcaagactgaggccaagcagcccgcgaccctccggaagtactgcatcgaggccaagttgaccaacactactaccgattcccggtgcccgacccaaggagaaccaactctgaacgaagaacaggataagcggtttgtgtgcaagcactcaatggtggacaggggatggggcaacggctgtggactgttcggaaagggtggtattgtgacctgtgcaatgtttacctgtaaaaagaatatggaggggaagatcgtgcagcctgaaaatctcgagtacactgtcgtcatcaccccgcactcgggagaggagcacgctgtgggcaacgacaccggaaagcacggaaaggaggtcaagataaccccgcaatcctccattacggaagccgaactgactggttacggcaccgtgactatggagtgctcccctcggaccggcctggacttcaacgaaatggtgctgctccaaatggaagataaggcctggctggtgcacaggcagtggttcctggatctcccgctgccgtggctgcctggcgctgacactcagggaagcaactggatccagaaggaaaccctcgtgacctttaagaacccccacgccaagaagcaggatgtggtggtgttgggaagccaggagggggccatgcatactgccctcaccggcgcgaccgaaatccagatgtcgtccggcaatctgctgttcaccggacacctcaagtgtcgccttcggatggacaagctgcagctgaagggaatgagctacagcatgtgcaccgggaagttcaagatcgtgaaggaaatcgccgaaacccagcacggaaccatcgtgatccgggtgcagtacgagggcgacggttctccctgcaaaatccccttcgaaatcatggatctggagaagagacacgtcctgggtcgcctgatcaccgtgaaccccattgtgactgagaaggactccccagtgaacatcgaagcggagcccccattcggagacagctacattatcattggtgccgaaccggggcagctgaaactggactggttcaagaagggcagctcgattggccaaatgttcgaaacgacaatgcggggcgcaaagcgcatggccatcctgggagacactgcctgggacttcgggtcccttgggggggtgttcacctcgatcggaaaagccttgcaccaagtgttcggcgcaatctacggcgccgcgttctcgggagtctcctggactatgaagatcctgatcggtgtcatcatcacctggatcgggatgaactcccggtccacttccctctcggtgtcactcgtgcttgtgggaattgtcaccctgtacctcggagtgatggtgcaggcctga

SEQ ID NO: 151 - DNA, 2058 bp, Dengue virus
atgctgaatattctgaaccgacgccgccgcactgccggaatcattatcatgatgatccctaccgtgatggcgttccatctcaccactcggaatggcgaaccccatatgatcgtgtcgagacaggaaaagggaaagagccttttgttcaaaactgaagatggagtgaacatgtgcactctcatggcaatggatctgggcgaactgtgcgaagataccatcacttacaagtgtccgctgttgagacagaacgagcctgaggacatcgactgctggtgtaacagcacttccacctgggtcacctacggcacttgcactaccaccggagaacaccggcgcgagaagaggagcgtggctcttgtgccgcacgtcggcatgggactcgagactcggaccgaaacctggatgtcatccgaaggagcctggaaacacgcccaacggatcgaaatttggatcctgagacaccccggtttcactatcatggccgcaatcctggcgtacactattggcaccacgcacttccagagggccctcattttcatcctcctgactgccgtggcgccatccatgaccatgagatgtattggcatttccaaccgcgatttcgtggagggagtgtccggaggatcctgggtcgacatcgtgctggaacacggatcttgcgtcaccaccatggctaagaacaagcccaccctcgacttcgagctgatcaagacagaagccaagcagccggccaccctccgcaagtattgcattgaagccaagcttaccaacaccaccaccgagtcgcggtgcccaacccaaggagagccgagcctcaatgaggaacaggacaagcgcttcgtgtgcaaacacagcatggtcgaccggggttggggcaacggatgtggcctgttcgggaagggtggcattgtgacttgcgcaatgttcacttgcaagaagaacatggaggggaaagtggtgcaacccgagaacctggagtacaccatcgtcgtgaccccacactccggagaggagcacgccgtgggaaacgacacggggaagcatggaaaggagatcaaggtcacaccccaatcatctattaccgaggccgaactgaccggatacggtactgtgacgatggagtgcagcccgaggactggactggacttcaacgaaatggtgctgctgcaaatggagaacaaggcctggctcgtgcaccggcagtggtttctggatctcccactgccgtggttgccgggagccgacacccaggggtcgaactggatccagaaggaaactcttgtgacgtttaagaatcctcacgcgaagaagcaggacgtggtggtcctgggatcgcaggaaggagctatgcacaccgctctgaccggcgccactgagatccagatgtcctcgggcaacctcctgttcaccggtcatctgaagtgccggctgcggatggacaaattgcagctgaaggggatgtcctactccatgtgcaccgggaagttcaaggtcgtgaaggagatcgcggaaactcagcacggcaccattgtcattagagtgcagtacgagggagatggttcaccgtgcaagataccgttcgaaatcatggacctggaaaagagacatgtcttgggacgcctgatcactgtgaaccctatcgtgaccgaaaaggactcccctgtgaacatcgaggcggagccgcctttcggcgactcctacatcattatcggagtggagcccgggcagctgaagctcaactggtttaagaaggggtccagcatcggccagatgttcgaaaccaccatgcggggggcgaagaggatggcgatcctgggagacaccgcctgggatttcggttcactgggcggagtgttcacctccatcggaaaggccctgcaccaagtgttcggcgcaatctacggtgctgccttctcgggagtctcctggaccatgaagatcctgatcggcgtgattatcacatggatcggcatgaacagccggtcaacctccctttccgtgtccctggtgctggtcggcatcgtgactctgtacctgggcgtgatggtgcaggcctga

SEQ ID NO: 152 - DNA, 2058 bp, Dengue virus
atgctgaacattctgaaccggagaagaagaaccgccggcattattatcatgatgattcccactgtgatggcatttcacctgaccacccggaacggagaacctcatatgatcgtgtcgagacaggagaagggaaagtccctgctgttcaagacagaaaacggagtgaacatgtgcaccctgatggccatggatctcggcgaactgtgcgaggatactatcacctacaactgtccgttgctgcgccaaaacgagccggaggacatcgactgctggtgtaactccacgtcgacctgggtcacctacggcacttgcaccgcgaccggcgaacacagaagagagaaacgctccgtcgctctggtgccgcacgtcgggatggggcttgaaacccggactgaaacctggatgagctcggagggcgcttggaagcatgcccagcgcatcgaaacttgggtgctgaggcatccaggcttcacaatcatggccgccatcctcgcgtacaccatcggtactacgtacttccagcgggtgttgatcttcattctgctgaccgccgtggcccctagcatgaccatgcggtgcatcgggatctccaaccgcgatttcgtggagggggtgtccggtggaagctgggtggacattgtgctggagcacggctcgtgcgtgaccaccatggccaagaacaagcccacccttgattttgagctgatcaagaccgaagcgaaacaccccgcgaccctccggaagtactgcattgaagccaagctcaccaacactaccacggcctcccggtgccctacccaaggagaaccttccttgaacgaagaacaggacaagcgcttcgtgtgcaagcattcaatggtggaccggggctggggaaatggctgtggcctcttcggaaaaggcggaattgtgacttgcgcaatgttcacttgcaagaagaacatggagggaaagattgtgcagcccgagaacctcgagtacactattgtcatcactccccactccggcgaagaaaacgctgtcggcaacgacaccggaaagcatggaaaggagatcaaggtcaccccgcaatcctcaattactgaggcagaactgaccggttacggaactgtgactatggagtgttcccctcgcaccggcctcgatttcaacgagatggtgctgctgcaaatggagaacaaggcctggctggtgcaccggcagtggttcctcgatttgcccctgccgtggctgccgggagccgacactcagggatccaactggatccagaaagaaaccctcgtgaccttcaaaaacccccacgcgaagaagcaggacgtggtggtgctgggttcccaagaaggggcgatgcataccgccctgactggtgctaccgaaatccagatgtcaagcggaaatctcctgtttaccggtcacctgaagtgcaggctccggatggacaagttgcagctgaaggggatgtcgtacagcatgtgtactgggaagttcaaggtcgtgaaggagattgccgaaacccagcacggaaccatagtcatcagggtccagtacgagggcgacggcagcccttgcaagatcccgttcgagatcatggatctggagaagcgacacgtgctgggccggcttatcactgtgaatccaatcgtgaccgagaaagactcgcccgtgaacatcgaagccgagccgccgttcggcgactcatacatcatcatcggcgtggaaccaggacagctgaagctgtcatggttcaagaagggttccagcattggtcagatgttcgaaacaacgatgcgcggagccaagcgcatggctatccttggggacaccgcctgggacttcgggtcgctgggaggagtgtttaccagcatcggaaaggccctgcaccaagtgttcggtgccatctacggagccgcattttccggagtgtcgtggactatgaagattctgatcggcgtcgtgattacctggatcgggatgaactccaggtctacttccctctccgtgagcctggtgctggtcggcgtggtcaccctgtatctgggcgtgatggtccaggcttag

SEQ ID NO: 153 - DNA, 119 bp, Dengue virus
tgataataggctggagcctcggtggccatgcttcttgccccttgggcctccccccagcccctcctccccttcctgcacccgtacccccgtggtctttgaataaagtctgagtgggcggc

SEQ ID NO: 154 - DNA, 119 bp, Dengue virus; identical to SEQ ID NO: 153

SEQ ID NO: 155 - DNA, 119 bp, Dengue virus; identical to SEQ ID NO: 153

SEQ ID NO: 156 - DNA, 119 bp, Dengue virus; identical to SEQ ID NO: 153

SEQ ID NO: 157 - DNA, 119 bp, Dengue virus; identical to SEQ ID NO: 153

SEQ ID NO: 158 - DNA, 119 bp, Dengue virus; identical to SEQ ID NO: 153

SEQ ID NO: 159 - DNA, 92 bp, Dengue virus; identical to SEQ ID NO: 135

SEQ ID NO: 160 - DNA, 119 bp, Dengue virus; identical to SEQ ID NO: 153

SEQ ID NO: 161 - DNA, 119 bp, Dengue virus; identical to SEQ ID NO: 153

SEQ ID NO: 162 - protein, 685 aa, Dengue virus
MLNILNRRRRTAGIIIMMIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQA

SEQ ID NO: 163 - protein, 685 aa, Dengue virus
MLNILNRRRRTAGIIIMMIPTVMAFHLTTRNGEPHMIVGRQEKGKSLLFKTEDGVNMCTLMAIDLGELCEDTITYKCPLLRQNEPEDIDCWCNSTSTWVTYGTCATTGEHRREKRSVALVPHVGMGLETRTETWMSSEGAWKHVQRIETWILRHPGFTIMAAILAYTIGTTHFQRALIFILLTAVAPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSTTEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 164 - protein, 685 aa, Dengue virus
MLNILNRRRRTAGIIIMMIPTVMAFHLTTRNGEPHMIVGRQEKGKSLLFKTEDGVNMCTLMAIDLGELCEDTITYKCPLLRQNEPEDIDCWCNSTSTWVTYGTCATTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFLCKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQA

SEQ ID NO: 165 - protein, 685 aa, Dengue virus
MLNILNRRRRTAGIIIMMIPTVMAFHLTTRNGEPHMIVSRQEKGKSLLFKTEDGVNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIETEAKQPATLRKYCIEAKLTNTTTDSRCPTQGEPSLNEEQDKRFVCKHSMVDRGWGNGCGLFGKGGIVTCAMFTCKKNMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMIETTMRGAKRMAILGDTAWDFGSLGGVFTSIGKALHQVFGAIYGAAFSGVSWIMKILIGVIITWIGMNSRSTSLSVSLVLVGVVTLYLGVMVQA

SEQ ID NO: 166 - protein, 685 aa, Dengue virus
MLNILNRRRRTAGIIIMMIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMKDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKTPFEIMDLEKRHVLGRLTTVNPIVTEKDSPVNIEAEPPFGDSYIIIGVEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQA

SEQ ID NO: 167 - protein, 685 aa, Dengue virus
MLNILNRRRRTAGIIIMMIPTVMAFHLTTRNGEPHMIVSRQEKGKSLLFKTEVGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALILILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTITMECSPRTGLDFNEIVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 168 - protein, 685 aa, Dengue virus
MLNILNRRRRTAGIIIMMIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGAEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQA

SEQ ID NO: 169 - protein, 685 aa, Dengue virus
MLNILNRRRRTAGIIIMMIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIEIWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKVVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQA

SEQ ID NO: 170 - protein, 685 aa, Dengue virus
MLNILNRRRRTAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQA

SEQ ID NO: 171 - protein, 100 aa, Dengue virus
MNNQRKKTGRPSFNMLKRARNRVSTVSQLAKRFSKGLLSGQGPMKLVMAFIAFLRFLAIPPTAGILARWGSFKKNGAIKVLRGFKKEISNMLNIMNRRKR

SEQ ID NO: 172 - protein, 100 aa, Dengue virus
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINQRKK

SEQ ID NO: 173 - protein, 100 aa, Dengue virus
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRR

SEQ ID NO: 174 - protein, 114 aa, Dengue virus
MNNQRKKTGRPSFNMLKRARNRVSTVSQLAKRFSKGLLSGQGPMKLVMAFIAFLRFLAIPPTAGILARWGSFKKNGAIKVLRGFKKEISNMLNIMNRRKRSVTMLLMLLPTALA

SEQ ID NO: 175 - protein, 114 aa, Dengue virus
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINQRKKTSLCLMMILPAALA

SEQ ID NO: 176 - protein, 114 aa, Dengue virus
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMA

SEQ ID NO: 177 - protein, 113 aa, Dengue virus
MNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKRSTITLLCLIPTVMA

SEQ ID NO: 178 - protein, 99 aa, Dengue virus
MNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKR

SEQ ID NO: 179 - protein, 493 aa, Dengue virus
MRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWASGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATERGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 180 - protein, 495 aa, Dengue virus
MRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKKKSWLVHKQWFLDLPLPWTSGASTSQETWNRQDLLVTFKTAHAKKQEVVVLGSQEGAMHTALTGATEIQTSGTTTIFAGHLKCRLKMDKLILKGMSYVMCTGSFKLEKEVAETQHGTVLVQVKYEGTDAPCKIPFSSQDEKGVTQNGRLITANPIVTDKEKPVNIEAEPPFGESYIVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQA

SEQ ID NO: 181 - protein, 495 aa, Dengue virus
MRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 182 - protein, 491 aa, Dengue virus
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVRIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCEVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGF

SEQ ID NO: 183 - protein, 75 aa, Dengue virus
SVALTPHSGMGLETRAETWMSSEGAWKHAQRVESWILRNPGFALLAGFMAYMIGQTGIQRTVFFVLMMLVAPSYG

SEQ ID NO: 184 - protein, 75 aa, Dengue virus
SVALAPHVGMGLDTRTQTWMSAEGAWRQVEKVETWALRHPGFTILALFLAHYIGTSLTQKVVIFILLMLVTPSMT

SEQ ID NO: 185 - protein, 75 aa, Dengue virus
SVALAPHVGLGLETRTETWMSSEGAWKQIQKVETWALRHPGFTVIALFLAHAIGTSITQKGIIFILLMLVTPSMA

SEQ ID NO: 186 - protein, 75 aa, Dengue virus
SVALVPHVGMGLETRTETWMSSEGAWKHVQRIETWILRHPGFTMMAAILAYTIGTTHFQRALIFILLTAVTPSMT

SEQ ID NO: 187 - protein, 167 aa, Artificial Sequence
  Synthetic Polypeptide
MLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTE

SEQ ID NO: 188 - protein, 125 aa, Artificial Sequence
  Synthetic Polypeptide
MLESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTE

SEQ ID NO: 189 - protein, 177 aa, Artificial Sequence
  Synthetic Polypeptide
MRVTAPRTVLLLLSAALALTETWALESIINFEKLTELESIINFEKLTELESIINFEKLTELESIINFEKLTELESIINFEKLTELESIINFEKLTELESIINFEKLTELESIINFEKLTEGSIVGIVAGLAVLAVVVIGAVVATVMCRRKSSGGKGGSYSQAASSDSAQGSDVSLTA

SEQ ID NO: 190 - protein, 205 aa, Artificial Sequence
  Synthetic Polypeptide
MRVTAPRTVLLLLSAALALTETWALESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTEGFLGLESIINFEKLTEGSIVGIVAGLAVLAVVVIGAVVATVMCRRKSSGGKGGSYSQAASSDSAQGSDVSLTA

SEQ ID NO: 191 - protein, 13 aa, Artificial Sequence
  Synthetic Polypeptide
MSIINFEKLKDEL

SEQ ID NO: 192 - protein, 93 aa, Artificial Sequence
  Synthetic Polypeptide
MRVTAPRTVLLLLSAALALTETWALESIINFEKLTEGSIVGIVAGLAVLAVVVIGAVVATVMCRRKSSGGKGGSYSQAASSDSAQGSDVSLTA

SEQ ID NO: 193 - protein, 113 aa, Artificial Sequence
  Synthetic Polypeptide
METDTLLLWVLLLWVPGSTGDSIINFEKLGFLGSIINFEKLGFLGSIINFEKLGFLGSIINFEKLGFLGSIINFEKLGFLGSIINFEKLGFLGSIINFEKLGFLGSIINFEKL

SEQ ID NO: 194 - protein, 247 aa, Artificial Sequence
  Synthetic Polypeptide
MRVTAPRTVLLLLSAALALTETWALESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGGGGSGGGGSLESIINFEKLTEGSIVGIVAGLAVLAVVVIGAVVATVMCRRKSSGGKGGSYSQAASSDSAQGSDVSLTA

SEQ ID NO: 195 - protein, 97 aa, Artificial Sequence
  Synthetic Polypeptide
MLESIINFEKLTELESIINFEKLTELESIINFEKLTELESIINFEKLTELESIINFEKLTELESIINFEKLTELESIINFEKLTELESIINFEKLTE

SEQ ID NO: 196 - protein, 9 aa, Artificial Sequence
  Synthetic Polypeptide
MSIINFEKL

SEQ ID NO: 197 - protein, 134 aa, Artificial Sequence
  Synthetic Polypeptide
METDTLLLWVLLLWVPGSTGDHPFTEDDAVDPNDSDIDPESRSIINFEKLGFLGSIINFEKLGFLGSIINFEKLGFLGSIINFEKLGFLGSIINFEKLGFLGSIINFEKLGFLGSIINFEKLGFLGSIINFEKL

SEQ ID NO: 198 - protein, 159 aa, Artificial Sequence
  Synthetic Polypeptide
MSIINFEKLGFLGSIINFEKLGFLGSIINFEKLGFLGSIINFEKLGFLGSIINFEKLGFLGSIINFEKLGFLGSIINFEKLGFLGSIINFEKLPPPSTVSNMIIIEVLIVLGAVINIGAMVAFVLKSKRKIGGKGGVYALAGGSNSIHGSALFLEAFKA

SEQ ID NO: 199-206 - skipped (8 entries)

SEQ ID NO: 207 - protein, 685 aa, Dengue virus; identical to SEQ ID NO: 168

SEQ ID NO: 208 - protein, 685 aa, Dengue virus; identical to SEQ ID NO: 162

SEQ ID NO: 209 - protein, 685 aa, Dengue virus; identical to SEQ ID NO: 169

SEQ ID NO: 210 - protein, 685 aa, Dengue virus; identical to SEQ ID NO: 170

SEQ ID NO: 211-212 - skipped (2 entries)

SEQ ID NO: 213 - protein, 9 aa, Artificial Sequence
  Synthetic Polypeptide
KQWFLDLPL

SEQ ID NO: 214 - protein, 9 aa, Artificial Sequence
  Synthetic Polypeptide
RQWFLDLPL

SEQ ID NO: 215 - protein, 9 aa, Artificial Sequence
  Synthetic Polypeptide
RQWFFDLPL

SEQ ID NO: 216 - protein, 9 aa, Artificial Sequence
  Synthetic Polypeptide
TALTGATEI

SEQ ID NO: 217 - protein, 9 aa, Artificial Sequence
  Synthetic Polypeptide
TTDISEMGA

SEQ ID NO: 218 - protein, 9 aa, Artificial Sequence
  Synthetic Polypeptide
TMWHVTRGA

SEQ ID NO: 219 - protein, 9 aa, Artificial Sequence
  Synthetic Polypeptide
MWHVTRGAV

SEQ ID NO: 220 - protein, 9 aa, Artificial Sequence
  Synthetic Polypeptide
GLYGNGVVT

SEQ ID NO: 221 - protein, 9 aa, Artificial Sequence
  Synthetic Polypeptide
TLILAPTRV

SEQ ID NO: 222 - protein, 9 aa, Artificial Sequence
  Synthetic Polypeptide
LILAPTRVV

SEQ ID NO: 223 - protein, 9 aa, Artificial Sequence
  Synthetic Polypeptide
ILAPTRVVA

SEQ ID NO: 224 - protein, 9 aa, Artificial Sequence
  Synthetic Polypeptide
VVAAEMEEA

SEQ ID NO: 225 - protein, 9 aa, Artificial Sequence
  Synthetic Polypeptide
IVDLMCHAT

SEQ ID NO: 226 - protein, 9 aa, Artificial Sequence
  Synthetic Polypeptide
LMCHATFTM

SEQ ID NO: 227 - protein, 9 aa, Artificial Sequence
  Synthetic Polypeptide
MGEAAAIFM

SEQ ID NO: 228 - protein, 9 aa, Artificial Sequence
  Synthetic Polypeptide
GEAAAIFMT

SEQ ID NO: 229 - protein, 9 aa, Artificial Sequence
  Synthetic Polypeptide
KTVWFVPSI

SEQ ID NO: 230 - protein, 9 aa, Artificial Sequence
  Synthetic Polypeptide
LMRRGDLPV

SEQ ID NO: 231 - protein, 9 aa, Artificial Sequence
  Synthetic Polypeptide
TLLCDIGES

SEQ ID NO: 232 - protein, 9 aa, Artificial Sequence
  Synthetic Polypeptide
LLCDIGESS

SEQ ID NO: 233 - protein, 9 aa, Artificial Sequence
  Synthetic Polypeptide
AMTDTTPFG

SEQ ID NO: 234 - protein, 9 aa, Artificial Sequence
  Synthetic Polypeptide
GQQRVFKEK

SEQ ID NO: 235 - protein, 9 aa, Artificial Sequence
  Synthetic Polypeptide
KLTYQNKVV

SEQ ID NO: 236 - protein, 9 aa, Artificial Sequence
  Synthetic Polypeptide
AISGDDCVV

SEQ ID NO: 237 - protein, 9 aa, Artificial Sequence
  Synthetic Polypeptide
LMYFHRRDL

SEQ ID NO: 238 - protein, 9 aa, Artificial Sequence
  Synthetic Polypeptide
RTLILAPTR

SEQ ID NO: 239 - protein, 9 aa, Artificial Sequence
  Synthetic Polypeptide
TLILAPTRV

SEQ ID NO: 240 - protein, 9 aa, Artificial Sequence
  Synthetic Polypeptide
MCHATFTMR

SEQ ID NO: 241 - protein, 9 aa, Artificial Sequence
  Synthetic Polypeptide
TVWFVPSIK

SEQ ID NO: 242 - protein, 9 aa, Artificial Sequence
  Synthetic Polypeptide
GQQRVFKEK

SEQ ID NO: 243 - protein, 9 aa, Artificial Sequence
  Synthetic Polypeptide
CVYNMMGKR

SEQ ID NO: 244 - protein, 9 aa, Artificial Sequence
  Synthetic Polypeptide
HTMWHVTRG

SEQ ID NO: 245 - protein, 9 aa, Artificial Sequence
  Synthetic Polypeptide
RTLILAPTR

SEQ ID NO: 246 - protein, 9 aa, Artificial Sequence
  Synthetic Polypeptide
TLILAPTRV

SEQ ID NO: 247 - protein, 9 aa, Artificial Sequence
  Synthetic Polypeptide
MCHATFTMR

SEQ ID NO: 248 - protein, 9 aa, Artificial Sequence
  Synthetic Polypeptide
ATFTMRLLS

SEQ ID NO: 249 - protein, 9 aa, Artificial Sequence
  Synthetic Polypeptide
GEAAAIFMT

SEQ ID NO: 250 - protein, 9 aa, Artificial Sequence
  Synthetic Polypeptide
KTVWFVPSI

SEQ ID NO: 251 - protein, 9 aa, Artificial Sequence
  Synthetic Polypeptide
TVWFVPSIK

SEQ ID NO: 252 - protein, 9 aa, Artificial Sequence
  Synthetic Polypeptide
GQQRVFKEK

SEQ ID NO: 253 - protein, 9 aa, Artificial Sequence
  Synthetic Polypeptide
CVYNMMGKR

SEQ ID NO: 254 - protein, 9 aa, Artificial Sequence
  Synthetic Polypeptide
VYNMMGKRE

SEQ ID NO: 255 - protein, 9 aa, Artificial Sequence
  Synthetic Polypeptide
YNMMGKREK

SEQ ID NO: 256 - protein, 9 aa, Artificial Sequence
  Synthetic Polypeptide
NMMGKREKK

SEQ ID NO: 257 - protein, 9 aa, Artificial Sequence
  Synthetic Polypeptide
GTYGLNTFT

SEQ ID NO: 258 - protein, 9 aa, Artificial Sequence
  Synthetic Polypeptide
ISGDDCVVK

SEQ ID NO: 259 - protein, 9 aa, Artificial Sequence
  Synthetic Polypeptide
LMCHATFTM

SEQ ID NO: 260 - protein, 9 aa, Artificial Sequence
  Synthetic Polypeptide
CHATFTMRL

SEQ ID NO: 261 - protein, 9 aa, Artificial Sequence
  Synthetic Polypeptide
GEAAAIFMT

SEQ ID NO: 262 - protein, 9 aa, Artificial Sequence
  Synthetic Polypeptide
KTVWFVPSI

SEQ ID NO: 263 - protein, 9 aa, Artificial Sequence
  Synthetic Polypeptide
HWTEAKMLL

SEQ ID NO: 264 - protein, 9 aa, Artificial Sequence
  Synthetic Polypeptide
WTEAKMLLD

SEQ ID NO: 265 - protein, 9 aa, Artificial Sequence
  Synthetic Polypeptide
LGCGRGGWS

SEQ ID NO: 266 - protein, 9 aa, Artificial Sequence
  Synthetic Polypeptide
MAMTDTTPF

SEQ ID NO: 267 - protein, 9 aa, Artificial Sequence
  Synthetic Polypeptide
MYADDTAGW

SEQ ID NO: 268 - protein, 9 aa, Artificial Sequence
  Synthetic Polypeptide
VGTYGLNTF

SEQ ID NO: 269 - protein, 9 aa, Artificial Sequence
  Synthetic Polypeptide
YFHRRDLRL

SEQ ID NO: 270 - protein, 9 aa, Artificial Sequence
  Synthetic Polypeptide
FKPGTSGSP

SEQ ID NO: 271 - protein, 9 aa, Artificial Sequence
  Synthetic Polypeptide
KPGTSGSPI

SEQ ID NO: 272 - protein, 9 aa, Artificial Sequence
  Synthetic Polypeptide
IPERSWNSG

SEQ ID NO: 273 - protein, 9 aa, Artificial Sequence
  Synthetic Polypeptide
PERVILAGP

SEQ ID NO: 274 - protein, 9 aa, Artificial Sequence
  Synthetic Polypeptide
LMRRGDLPV

SEQ ID NO: 275 - protein, 9 aa, Artificial Sequence
  Synthetic Polypeptide
PLSRNSTHE

SEQ ID NO: 276 - protein, 9 aa, Artificial Sequence
  Synthetic Polypeptide
LSRNSTHEM

SEQ ID NO: 277 - protein, 9 aa, Artificial Sequence
  Synthetic Polypeptide
SRNSTHEMY

SEQ ID NO: 278 - protein, 9 aa, Artificial Sequence
  Synthetic Polypeptide
MAMTDTTPF

SEQ ID NO: 279 - protein, 9 aa, Artificial Sequence
  Synthetic Polypeptide
TPFGQQRVF

SEQ ID NO: 280 - protein, 9 aa, Artificial Sequence
  Synthetic Polypeptide
LMYFHRRDL

SEQ ID NO: 281 - protein, 9 aa, Artificial Sequence
  Synthetic Polypeptide
LRTLILAPT

SEQ ID NO: 282 - protein, 9 aa, Artificial Sequence
  Synthetic Polypeptide
LMCHATFTM

SEQ ID NO: 283 - protein, 9 aa, Artificial Sequence
  Synthetic Polypeptide
ARGYISTRV

SEQ ID NO: 284 - protein, 9 aa, Artificial Sequence
  Synthetic Polypeptide
RRGDLPVWL

SEQ ID NO: 285 - protein, 9 aa, Artificial Sequence
  Synthetic Polypeptide
GQQRVFKEK

SEQ ID NO: 286 - protein, 9 aa, Artificial Sequence
  Synthetic Polypeptide
SRAIWYMWL

SEQ ID NO: 287 - protein, 9 aa, Artificial Sequence
  Synthetic Polypeptide
FKLTYQNKV

SEQ ID NO: 288 - protein, 9 aa, Artificial Sequence
  Synthetic Polypeptide
FKPGTSGSP

SEQ ID NO: 289 - protein, 9 aa, Artificial Sequence
  Synthetic Polypeptide
LAPTRVVAA

SEQ ID NO: 290 - protein, 9 aa, Artificial Sequence
  Synthetic Polypeptide
LMCHATFTM

SEQ ID NO: 291 - protein, 9 aa, Artificial Sequence
  Synthetic Polypeptide
CHATFTMRL

SEQ ID NO: 292 - protein, 9 aa, Artificial Sequence
  Synthetic Polypeptide
HATFTMRLL

SEQ ID NO: 293 - protein, 9 aa, Artificial Sequence
  Synthetic Polypeptide
ATFTMRLLS

SEQ ID NO: 294 - protein, 9 aa, Artificial Sequence
  Synthetic Polypeptide
KTVWFVPSI

SEQ ID NO: 295 - protein, 9 aa, Artificial Sequence
  Synthetic Polypeptide
LSRNSTHEM

SEQ ID NO: 296 - protein, 9 aa, Artificial Sequence
  Synthetic Polypeptide
QQRVFKEKV

SEQ ID NO: 297 - protein, 9 aa, Artificial Sequence
  Synthetic Polypeptide
YGLNTFTNM

SEQ ID NO: 298 - protein, 9 aa, Artificial Sequence
  Synthetic Polypeptide
LMYFHRRDL

SEQ ID NO: 299 - protein, 8 aa, Artificial Sequence
  Synthetic Polypeptide
TALGATEI

SEQ ID NO: 300 - protein, 9 aa, Artificial Sequence
  Synthetic Polypeptide
HSMTNAVTI

SEQ ID NO: 301 - protein, 9 aa, Artificial Sequence
  Synthetic Polypeptide
IILYYYELY

SEQ ID NO: 302 - protein, 9 aa, Artificial Sequence
  Synthetic Polypeptide
ACLVGDKVM

SEQ ID NO: 303 - protein, 400 aa, Dengue Virus
MRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKKKSWLVHKQWFLDLPLPWTSGASTSQETWNRQDLLVTFKTAHAKKQEVVVLGSQEGAMHTALTGATEIQTSGTTTIFAGHLKCRLKMDKLILKGMSYVMCTGSFKLEKEVAETQHGTVLVQVKYEGTDAPCKIPFSSQDEKGVTQNGRLITANPIVTDKEKPVNIEAEPPFGESYIVVGAGEKALKLSWFKKGSSIGK

SEQ ID NO: 304 - protein, 394 aa, Dengue Virus
MRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKK

SEQ ID NO: 305 - protein, 392 aa, Dengue Virus
MRCVGCGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKIVQHENLKYTVIITVHTGDQHQVGNETQGVTAEITSQASTAEAILPEYGTLGLECSPRTGLDFNEMILLTMKDKAWMVHRQWFFDLPLPWTSGATTKTPTWNRKELLVTFKNAHAKKQEVVVLGSQEGAMHTALTGATEIQTSGGTSIFAGHLKCRLKMDKLKLKGMSYAMCLNTFVLKKEVSETQHGTILIKVEYKGEDAPCKIPFSTEDGQGKAHNGRLITANFVVTKKEEPVNIEAEPPFGESNIVIGIGDKALKINWYRK

SEQ ID NO: 306 - protein, 400 aa, Dengue Virus
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVRIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCEVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGK

SEQ ID NO: 307 - protein, 9 aa, Artificial Sequence
  Synthetic Polypeptide
  misc_feature (2)..(2): Xaa is Ala, Ser, or Thr
  misc_feature (4)..(4): Xaa is Leu or Met
  misc_feature (7)..(7): Xaa is Lys or Arg
KXWXVHXQW

SEQ ID NO: 308 - protein, 9 aa, Artificial Sequence
  Synthetic Polypeptide
  misc_feature (3)..(3): Xaa is Thr, Ser, Val, or Ala
  misc_feature (6)..(6): Xaa is Leu, Thr, or Ser
  misc_feature (7)..(7): Xaa is Leu, Thr, or Ser
  misc_feature (8)..(8): Xaa is Lys, Ser, or Thr
SYXMCXXXF

SEQ ID NO: 309 - protein, 9 aa, Artificial Sequence
  Synthetic Polypeptide
  misc_feature (5)..(5): Xaa is Asn, Thr, or Val
  misc_feature (6)..(6): Xaa is Ala or Pro
VTFKXXHAK

SEQ ID NO: 310 - protein, 9 aa, Artificial Sequence
  Synthetic Polypeptide
  misc_feature (1)..(1): Xaa is Lys or Arg
  misc_feature (5)..(5): Xaa is Leu or Phe
XQWFXDLPL

SEQ ID NO: 311 - protein, 9 aa, Artificial Sequence
  Synthetic Polypeptide
  misc_feature (1)..(1): Xaa is Ala or Gln
  misc_feature (3)..(3): Xaa is Lys or Thr
  misc_feature (4)..(4): Xaa is Leu or Ile
  misc_feature (5)..(5): Xaa is His, Ser, or Asn
  misc_feature (7)..(7): Xaa is Phe or Tyr
  misc_feature (8)..(8): Xaa is Lys or Arg
XLXXXWXXK

SEQ ID NO: 312 - protein, 9 aa, Artificial Sequence
  Synthetic Polypeptide
GWGNGCGLF

SEQ ID NO: 313 - protein, 15 aa, Artificial Sequence
  Synthetic Polypeptide
  misc_feature (1)..(1): Xaa is Asp or Glu
  misc_feature (3)..(3): Xaa is Asn or Tyr
  misc_feature (5)..(5): Xaa is Ile or Val
  misc_feature (6)..(6): Xaa is Ile or Val
  misc_feature (8)..(8): Xaa is Asn, Ile, or Ala
  misc_feature (9)..(9): Xaa is Glu or Gly
  misc_feature (10)..(10): Xaa is Asn, Glu, or Asp
  misc_feature (11)..(11): Xaa is Gly, Lys, or Ser
  misc_feature (12)..(12): Xaa is Gln or Ala
  misc_feature (14)..(14): Xaa is Thr or Leu
  misc_feature (15)..(15): Xaa is Ile or Leu
XSXIXXGXXXXXLXX

SEQ ID NO: 314 - protein, 15 aa, Artificial Sequence
  Synthetic Polypeptide
  misc_feature (4)..(4): Xaa is Val or Ile
  misc_feature (6)..(6): Xaa is Leu or Met
  misc_feature (7)..(7): Xaa is Gln, Thr, or Lys
  misc_feature (10)..(10): Xaa is Asp, Glu, or Lys
  misc_feature (12)..(12): Xaa is Ala, Ser, or Thr
  misc_feature (14)..(14): Xaa is Met or Leu
NEMXLXXMKXKXWXV

SEQ ID NO: 315 - protein, 15 aa, Artificial Sequence
  Synthetic Polypeptide
  misc_feature (2)..(2): Xaa is Leu or Met
  misc_feature (5)..(5): Xaa is Arg or Lys
  misc_feature (9)..(9): Xaa is Phe or Leu
WXVHXQWFXDLPLPW

SEQ ID NO: 316 - protein, 15 aa, Artificial Sequence
  Synthetic Polypeptide
  misc_feature (1)..(1): Xaa is Asn or Ile
  misc_feature (2)..(2): Xaa is Gln, Arg, or Tyr
  misc_feature (3)..(3): Xaa is Lys or Gln
  misc_feature (4)..(4): Xaa is Glu or Asp
  misc_feature (5)..(5): Xaa is Thr, Leu, or Arg
  misc_feature (6)..(6): Xaa is Met or Leu
  misc_feature (11)..(11): Xaa is Glu, Thr, or Val
  misc_feature (12)..(12): Xaa is Pro or Ala
XXXXXXVTFKXXHAK

SEQ ID NO: 317 - protein, 15 aa, Artificial Sequence
  Synthetic Polypeptide
  misc_feature (3)..(3): Xaa is Lys or Arg 220>
  misc_feature (4)..(4): Xaa is Val or Leu 220>
  misc_feature (5)..(5): Xaa is Arg or Lys
  misc_feature (7)..(7): Xaa is Glu or Asp
  misc_feature (10)..(10): Xaa is Gln, Lys, Thr, or Arg
  misc_feature (11)..(11): Xaa is Ile or Leu
  misc_feature (14)..(14): Xaa is Met or Ile
KCXXXMXKLXXKGXS

SEQ ID NO: 318 - protein, 672 aa, Dengue Virus; identical to SEQ ID NO: 84

SEQ ID NO: 319 - protein, 671 aa, Dengue Virus; identical to SEQ ID NO: 130

SEQ ID NO: 320 - protein, 672 aa, Dengue Virus; identical to SEQ ID NO: 84

SEQ ID NO: 321 - protein, 672 aa, Dengue Virus; identical to SEQ ID NO: 84

SEQ ID NO: 322 - protein, 672 aa, Dengue Virus; identical to SEQ ID NO: 84

SEQ ID NO: 323 - protein, 672 aa, Dengue Virus; identical to SEQ ID NO: 101

SEQ ID NO: 324 - protein, 671 aa, Dengue Virus
EVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 325 - protein, 672 aa, Dengue Virus; identical to SEQ ID NO: 93

SEQ ID NO: 326 - protein, 672 aa, Artificial Sequence; identical to SEQ ID NO: 84
  Synthetic Polypeptide

What is claimed is:

1. A method of inducing an immune response in a subject, the method comprising administering to the subject a Chikungunya virus (CHIKV) vaccine, comprising a ribonucleic acid (RNA) polynucleotide having an open reading frame encoding a CHIKV antigenic polypeptide comprising CHIKV E2 protein formulated in a lipid nanoparticle, in an amount effective to produce an antigen-specific immune response in the subject, wherein the lipid nanoparticle comprises a cationic lipid, a non-cationic lipid, a sterol, and a PEG-modified lipid.

2. The method of claim 1, wherein the antigen specific immune response comprises a T cell response or a B cell response.

3. The method of claim 1, wherein the subject is administered a single dose of the CHIKV vaccine.

4. The method of claim 1, wherein the subject is administered a booster dose of the CHIKV vaccine.

5. The method of claim 1, wherein the vaccine is administered to the subject by intradermal injection or intramuscular injection.

6. The method of claim 1, wherein an anti-CHIKV antigenic polypeptide antibody titer produced in the subject is increased by at least 1 log relative to a control.

7. The method of claim 1, wherein the anti-CHIKV antigenic polypeptide antibody titer produced in the subject is increased at least 2 times relative to a control.

8. The method of claim 1, wherein the effective amount is a total dose of 30 μg-1000 μg.

9. The method of claim 1, wherein the CHIKV antigenic polypeptide further comprises a CHIKV structural protein selected from a CHIKV E1, E3, 6K, and capsid (C) protein.

10. The method of claim 9, wherein the CHIKV antigenic polypeptide comprises: CHIKV E1 and E2 proteins; CHIKV E1, E2, and E3 proteins; CHIKV E1, E2, E3, and C proteins; or CHIKV E1, E2, E3, 6K, and C proteins.

11. The method of claim 1, wherein the open reading frame encodes at least two CHIKV antigenic polypeptides, or wherein the vaccine comprises at least two RNA polynucleotides each having an open reading frame encoding a CHIKV antigenic polypeptide.

12. The method of claim 1, wherein the RNA polynucleotide comprises a chemical modification.

13. The method of claim 12, wherein the chemical modification is a 1-methylpseudouridine.

14. The method of claim 13, wherein at least 80% of the uracil in the open reading frame has a chemical modification.

15. The method of claim 1, wherein the RNA polynucleotide further encodes a 5' terminal cap.

16. The method of claim 15, wherein the 5' terminal cap is 7mG(5')ppp(5')NlmpNp.

17. The method of claim 1, wherein the lipid nanoparticle carrier comprises 20-60 mol % cationic lipid, 5-25 mol % non-cationic lipid, 25-55 mol % sterol, and 0.5-5 mol % PEG-modified lipid.

18. The method of claim 1, wherein the cationic lipid is an ionizable cationic lipid and the non-cationic lipid is a neutral lipid, and the sterol is a cholesterol.

19. The method of claim 1, wherein the cationic lipid is selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate.

20. A method of inducing an immune response in a subject, the method comprising administering to the subject a Chikungunya virus vaccine, comprising a messenger ribonucleic acid polynucleotide having an open reading frame encoding a E2 protein formulated in a lipid nanoparticle, in an amount effective to produce an antigen-specific immune response in the subject, wherein the lipid nanoparticle comprises 20-60 mol % ionizable cationic lipid, 5-25 mol % neutral lipid, 25-55 mol % cholesterol, and 0.5-5 mol % PEG-modified lipid.

* * * * *